US009592283B2

(12) United States Patent
Kolander et al.

(10) Patent No.: US 9,592,283 B2
(45) Date of Patent: Mar. 14, 2017

(54) **IMMUNOLOGICAL COMPOSITIONS CONTAINING ATTENUATED *HISTOPHILUS SOMNI***

(71) Applicant: MERIAL, INC., Duluth, GA (US)

(72) Inventors: Tammy Kolander, Worthington, MN (US); Paulraj Lawrence, Worthington, MN (US); Russell Bey, Arden Hills, MN (US)

(73) Assignee: MERIAL, INC., Duluth, GA (US)

( * ) Notice: Subject to any disclaimer, the term of this patent is extended or adjusted under 35 U.S.C. 154(b) by 0 days.

(21) Appl. No.: 14/668,656

(22) Filed: Mar. 25, 2015

(65) Prior Publication Data

US 2015/0273045 A1    Oct. 1, 2015

Related U.S. Application Data

(60) Provisional application No. 61/970,195, filed on Mar. 25, 2014.

(51) Int. Cl.
| | | |
|---|---|---|
| *A61K 39/102* | (2006.01) | |
| *A61K 45/06* | (2006.01) | |
| *C12N 1/36* | (2006.01) | |
| *C12N 1/38* | (2006.01) | |
| *A61K 39/00* | (2006.01) | |

(52) U.S. Cl.
CPC ............ *A61K 39/102* (2013.01); *A61K 45/06* (2013.01); *C12N 1/36* (2013.01); *C12N 1/38* (2013.01); *A61K 2039/522* (2013.01)

(58) Field of Classification Search
CPC ............ A61K 2039/522; A61K 39/102; A61K 45/06; C12N 1/36; C12N 1/38; C07K 14/47
See application file for complete search history.

(56) References Cited

U.S. PATENT DOCUMENTS 6,770,273 B1 *   8/2004   Corbeil et al. ............... 424/93.1
2011/0150933 A1 *   6/2011   Rosenbusch et al. ..... 424/264.1

OTHER PUBLICATIONS

Siddaramappa et al. BMC Genomics 12: 570, 1-20, 2011.*
Challacombe et al. 2007. Complete Genome Sequence of Haemophilus somnus (Histophilus somni) strain 129Pt and Comparison to Haemophilus ducreyi 35000 HP and Haemophilus influenzae Rd. Journal of Bacteriology 189(5); p. 1890-1898.
Geertsema, R. S. et al. 2008. Protection of mice against H. somni septicemia by vaccination with recombinant immunoglobulin binding protein subunits. Vaccine. 26:4506-4512.
Guzmán-Brambila, C et al. 2012. Two Outer Membrane Lipoproteins from H. somni are Immunogenic in Rabbits and Sheep and Induce Protection against Bacterial Challenge in Mice. Clinical and Vaccine Immunology. 19(11) : 1826-1832.
Korczak et. al. 2004. Phylogeny of the Family Pasteurellaceae based on rpoB sequences. International Journal of Systemic and Evolutionary Microbiology. 54; p. 1393-1399.
Perera, I. C. and Grove, A. 2010. Molecular Mechanisms of Ligand-Mediated Attenuation of DNA Binding by MarR Family Transcriptional Regulators. JMCB. 2(5):243-254.
Ward et al. 2006. Haemophilus somnus (Histophilus somni) in Bighorn Sheep Canadian Journal of Veterinary Research. 70; p. 34-42.

* cited by examiner

*Primary Examiner* — S. Devi
(74) *Attorney, Agent, or Firm* — Judy Jarecki-Black; Chad Kitchen; Merial Inc.

(57)    ABSTRACT

This disclosure provides attenuated *Histophilus somni* strains, compositions comprising same, and methods of production and use thereof. The attenuated strains may express lower or no levels of various virulence-associated genes, relative to the corresponding pathogenic bacteria Advantageously, the attenuated *Histophilus somni* strains may be administered orally, intranasally, intra-tracheally, or subcutaneously.

13 Claims, 1 Drawing Sheet

IMMUNOLOGICAL COMPOSITIONS CONTAINING ATTENUATED *HISTOPHILUS SOMNI*

INCORPORATION BY REFERENCE

This application claims priority to U.S. provisional application Ser. No. 61/970,195, filed on 25 Mar. 2014, and herein incorporated by reference in its entirety. All other references cited herein are also herein incorporated by reference in their entirety.

STATEMENT REGARDING SEQUENCE LISTING

The Sequence Listing associated with this application is provided in text format in lieu of a paper copy, and is hereby incorporated by reference into the specification. The name of the text file containing the Sequence Listing is MER_13_225P_ST25. The text file is 17,356 KB; it was created on Feb. 20, 2014; and it is being submitted electronically via EFS-Web, concurrent with the filing of the specification.

FIELD OF THE INVENTION

The present invention relates generally to genetically engineered, attenuated bacterial vaccines, particularly those providing broad, safe, and effective protection to bovines against infections/disease caused by *Histophilus somni* (formerly *Haemophilus somnus*). The invention further relates to methods of producing the attenuated bacteria, and to the identification of nucleic acid variations that are associated with decreased pathogenicity of the attenuated bacteria.

The invention accordingly relates to immunogenic or vaccine compositions comprising the bacteria of the invention; e.g., live attenuated bacteria. The bacteria also could be inactivated in the compositions; but it may be advantageous that the bacteria are live attenuated *Histophilus somni*. The invention therefore further relates to methods for preparing and/or formulating such compositions; e.g., culturing or growing or propagating the bacteria on or in suitable medium, harvesting the bacteria, optionally inactivating the bacteria, and optionally admixing with a suitable veterinarily or pharmaceutically acceptable carrier, excipient, diluent or vehicle and/or an adjuvant and/or stabilizer. Thus, the invention also relates to the use of the bacteria in formulating such compositions.

BACKGROUND OF THE INVENTION

Bovine Respiratory Disease Complex (BRDC) consists of multiple microbial pathogens and contributes to substantial economic loss to the cattle industry. Treatment costs including both preventative vaccination and medication following an outbreak are estimated to be near $4 billion per year (Griffin, 1997). Adding to the economic impact is the associated loss in performance observed in animals diagnosed with BRDC; with measurable losses to average daily gain, body weight at harvest, and beef quality grade (Babcock, 2010). Reports on specific monetary loss associated with decreased performance vary; likely due to varying case definitions of BRDC, but are estimated between $40 (Fulton, 2002) and almost $300 (Duff and Gaylean 2011) per animal. The performance loss has also been shown to significantly increase with the number of times an animal requires treatment for BRDC (Fulton, 2002).

*Histophilus somni* (formerly *Haemophilus somnus*) has been identified as a key contributor to BRDC (Duff and Gaylean 2011). This gram-negative pleomorphic coccobacillus belonging to the family Pasterellacea (Korczak, 2004) makes up part of the normal microbiota of the upper respiratory and urogenital tracts in cattle, sheep, and other ruminants (Ward, 2006). It is closely related to other bovine pathogens including *Pasteurella multocida* and *Mannheimia haemolytica* (both of which are also associated with BRDC) as well as the human pathogens *Haemophilus ducreyi* and *Haemophilus influenzae* (Challacombe, 2007).

Estimates place the isolation rate of *H. somni* from the upper respiratory tract of healthy calves as high as 50% with no clinical manifestations of disease; however animals diagnosed with BRDC have an even higher isolation rate for the bacteria (Griffin, 2010). Under stressful conditions or states of immunosuppression, *H. somni* may colonize the lower respiratory tract, endocardium, or central nervous system and has been identified as an etiological agent in diverse diseases such as pneumonia, endocarditis, arthritis, abortion, septicemia, and thromboembolic meningoencephalitis (TEME) (Ward, 2006).

At the time of slaughter, less than 15% of animals receiving proper treatment for BRDC (preventative vaccinations and appropriate antibiotics during an outbreak) show signs of lung lesions and these lesions involve less than 5% of the total lung (Griffin, 2010). Conversely, 50% of animals not receiving proper care display lung lesions at the time of slaughter, and these lesions may involve 15% or more of the total lung (Griffin, 2010). In one field study of over 10,000 animals, 459 calves (4.6%) died from disease of one form or another. Of the mortalities in the study, 279 (60.8%) were shown to be related to respiratory ailments, and of those with respiratory infections, 226 (81.0%) were associated with *H. somni* related pneumonia, pleurisy, or abscesses (Ribble, 1988). While antibiotic treatment may be successful in response to an *H. somni* infection, an increasing prevalence of antibiotic resistant field isolates is of concern (Duff and Gaylean, 2011). Preventative care by vaccination would be preferred as it is proactive rather than reactive and is much more cost effective.

Many *H. somni* vaccines are currently available from various animal health companies; however these vaccines are predominantly composed of killed bacterins and were licensed over thirty years ago with an aim in preventing TEME. The use of these bacterin vaccines has been effective against TEME, however has been shown to have neutral or even negative effects on respiratory disease in feedlot cattle. Negative side-effects include IgE induced anaphylactic shock and interactions when calves infected with Bovine Respiratory Syncytial Virus (BRSV) are vaccinated (Griffin, 2010). The decrease in prevalence of TEME and the emergence of *H. somni* related pneumonia in the US and myocarditis in Canada beginning in the late 1980's, have led to a need for further investigation of efficacious antigens for vaccine production (O'Toole, 2009).

*H. somni* related pneumonia is an economically significant condition for the beef and dairy industries. There is little evidence of field efficacy in currently available vaccines, so the need for research into next generation vaccine products is warranted.

SUMMARY OF THE INVENTION

An object of this invention is to provide attenuated bacteria as well as methods for treatment and prophylaxis of infection by *H. somni*.

In an embodiment, the vaccines comprise attenuated *H. somni*, which are less pathogenic as compared to a more virulent strain. Comprehensive comparative sequence analysis revealed the absence of important virulence factors in the attenuated *H. somni* strains, relative to more virulent strains. Thus, it is an object of the invention to provide attenuated *H. somni*, which are lacking in virulence factors possessed by more virulent *H. somni* strains.

As defined herein, the term "gene" will be used in a broad sense, and shall encompass both coding and non-coding sequences (i.e. upstream and downstream regulatory sequences, promoters, 5'/3' UTR, introns, and exons). Where reference to only a gene's coding sequence is intended, the term "gene's coding sequence" or "CDS" will be used interchangeably throughout this disclosure. When a specific nucleic acid is discussed, the skilled person will instantly be in possession of all derivable forms of that sequence (mRNA, vRNA, cRNA, DNA, protein, etc.).

The invention further provides methods for inducing an immunological (or immunogenic) or protective response against *H. somni*, as well as methods for preventing or treating *H. somni*, or disease state(s) caused by *H. somni*, comprising administering the attenuated *H. somni*, or a composition comprising the attenuated *H. somni* to animals in need thereof. Moreover, kits comprising at least the attenuated *H. somni* strain(s) and instructions for use are also provided.

These and other embodiments are disclosed or are obvious from and encompassed by, the following Detailed Description.

BRIEF DESCRIPTION OF DRAWINGS

A full and enabling disclosure of the present invention, including the best mode thereof, to one of ordinary skill in the art, is set forth more particularly in the remainder of the specification, including reference to the accompanying figures, wherein.

DETAILED DESCRIPTION OF THE INVENTION

Figure 1:
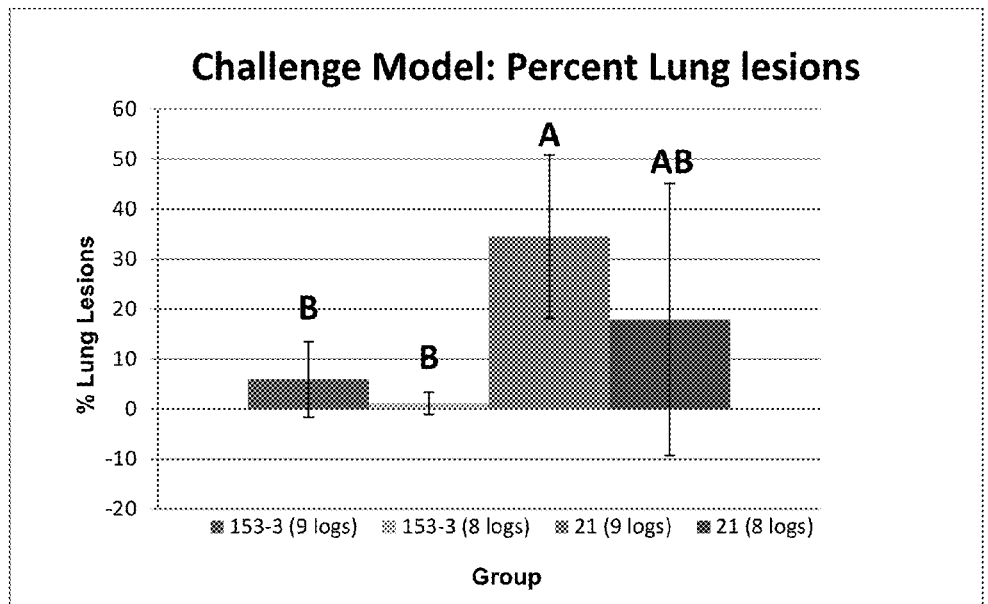
FIG. 1 shows the average percent lung lesions for each isolate and dose tested in the challenge model. Groups with different letters are significantly different according to Student's t performed on the arcsine transformed data.

The present invention provides nucleotide sequences and genes involved in the attenuation of a microorganism, such as bacteria, for instance, *H. somni*, products (e.g., proteins, antigens, immunogens, epitopes) encoded by the nucleotide sequences, methods for producing such nucleotide sequences, products, micro-organisms, and uses thereof, such as for preparing vaccine or immunogenic compositions or for eliciting an immunological or immune response or as a vector, e.g., as an expression vector (for instance, an in vitro or in vivo expression vector).

Mutations identified in nucleotide sequences and genes of micro-organisms produce novel and nonobvious attenuated mutants. These mutants are useful for the production of live attenuated immunogenic compositions or live attenuated vaccines having a high degree of immunogenicity.

Identification of the mutations provides novel and non-obvious nucleotide sequences and genes, as well as novel and nonobvious gene products encoded by the nucleotide sequences and genes.

In an embodiment, the invention provides an attenuated *H. somni* strain capable of providing a safe and effective immune response in cattle against *H. somni* or diseases caused by *H. somni*.

In an aspect, the invention provides bacteria containing an attenuating mutation in a nucleotide sequence or a gene wherein the mutation modifies the biological activity of a polypeptide or protein encoded by a gene, resulting in attenuated virulence of the bacteria.

In particular, the present invention encompasses attenuated *H. somni* strains and vaccines comprising the same, which elicit an immunogenic response in an animal, particularly the attenuated *H. somni* strains that elicit, induce or stimulate a response in a bovine.

Particular *H. somni* attenuated strains of interest have mutations in genes, relative to virulent strains. It is recognized that, in addition to strains having the disclosed mutations, attenuated strains having any number of mutations in the disclosed virulence genes can be used in the practice of this invention.

In another aspect, the novel attenuated *H. somni* strains are formulated into safe, effective vaccine against *H. somni* and infections/diseases cause by *H. somni*.

In an embodiment, the attenuated *H. somni* strain is capable of providing a safe and effective immune response in a bovine against *H. somni* or diseases caused by *H. somni*.

In a particular embodiment, the attenuated strain is lacking one or several virulence genes, relative to an otherwise genetically similar virulent strain. In an embodiment, the attenuated strain lacks and/or does not express the glycoside hydrolase family protein (HSM_1160) and the lipoprotein (HSM_1714). Absent genes that may also be contribute to the strain's attenuated phenotype include: multicopper oxidase type 3 (HSM_1726) and a TetR family transcriptional regulator (HSM_1734). In an even more particular embodiment, the attenuated strain is the same as that deposited in the ATCC under the designation PTA-121029.

In an embodiment, the strain may be administered intra-nasally or subcutaneously.

In another aspect, the invention encompasses an immunological composition comprising the disclosed attenuated *H. somni* strains. The composition may further comprise a pharmaceutically or veterinary acceptable vehicle, diluent or excipient.

In an embodiment, the composition may provide a safe and protective immune response in bovine against subsequent virulent *H. somni* challenge.

In still another embodiment, the composition may comprise a genetically engineered, non-naturally-occurring, attenuated *H. somni* strain, suitable for use in a safe and effective vaccine formulation, and having at least the following genes mutated, including completely deleted, to eliminate the ability of the genes to express their cognate gene product: HSM_0270, HSM_0338, HSM_0377, HSM_0598, HSM_0708, HSM_0749, HSM_0953, HSM_1160, HSM_1191, HSM_1257, HSM_1426, HSM_1616, HSM_1624, HSM_1728, HSM_1730, HSM_1734, HSM_1736, HSM_1737, HSM_1741, HSM_1793 and HSM_1889. In a particular embodiment, the engineered *H. somni* strain has an identical attenuated phenotype as compared with TK #4.

In a related embodiment, the composition may comprise a genetically engineered, non-naturally-occurring, attenuated *H. somni* strain, suitable for use in a safe and effective vaccine formulation, and having a sufficient number of the following genes mutated, including completely deleted, to eliminate the ability of the genes to express their cognate gene product: HSM_0270, HSM_0338, HSM_0377, HSM_0598, HSM_0708, HSM_0749, HSM_0953, HSM_1160, HSM_1191, HSM_1257, HSM_1426, HSM_1616, HSM_1624, HSM_1728, HSM_1730, HSM_1734, HSM_1736, HSM_1737, HSM_1741, HSM_1793 and HSM_1889. In a particular embodiment, the engineered *H. somni* strain has an identical attenuated phenotype as compared with TK #4.

In another embodiment, the composition may comprise a genetically engineered, non-naturally-occurring, attenuated *H. somni* strain, suitable for use in a safe and effective vaccine formulation, and having at least the following genes mutated, including completely deleted, to eliminate the ability of the gene to express its cognate gene product: HSM_0077, HSM_0270, HSM_0708, HSM_0975, HSM_1191, HSM_1257, HSM_1448, HSM_1542, HSM_1571, HSM_1624, HSM_1714, HSM_1726, HSM_1728, HSM_1730, HSM_1734, HSM_1736, HSM_1737, HSM_1741 and HSM_1793. In a particular embodiment, the engineered *H. somni* strain has an identical attenuated phenotype as compared with TK #42.

In a related embodiment, the composition may comprise a genetically engineered, non-naturally-occurring, attenuated *H. somni* strain, suitable for use in a safe and effective vaccine formulation, and having a sufficient number of the following genes mutated, including completely deleted, to eliminate the ability of the gene to express its cognate gene product: HSM_0077, HSM_0270, HSM_0708, HSM_0975, HSM_1191, HSM_1257, HSM_1448, HSM_1542, HSM_1571, HSM_1624, HSM_1714, HSM_1726, HSM_1728, HSM_1730, HSM_1734, HSM_1736, HSM_1737, HSM_1741 and HSM_1793. In a particular embodiment, the engineered *H. somni* strain has an identical attenuated phenotype as compared with TK #42.

In another embodiment, the composition may comprise a genetically engineered, non-naturally-occurring, attenuated *H. somni* strain, suitable for use in a safe and effective vaccine formulation, and having at least the following genes mutated, including completely deleted, to eliminate the ability of the gene to express its cognate gene product: HSM_0268, HSM_0270, HSM_0274, HSM_0598, HSM_0708, HSM_0749, HSM_0938, HSM_1022, HSM_1160, HSM_1191, HSM_1212, HSM_1257, HSM_1542, HSM_1571, HSM_1667, HSM_1728, HSM_1730, HSM_1736, HSM_1737, HSM_1741, HSM_1793 and HSM_1889. In a particular embodiment, the engineered *H. somni* strain has an identical attenuated phenotype as compared with TK #34.

In a related embodiment, the composition may comprise a genetically engineered, non-naturally-occurring, attenuated *H. somni* strain, suitable for use in a safe and effective vaccine formulation, and having a sufficient number of the following genes mutated, including completely deleted, to eliminate the ability of the gene to express its cognate gene product: HSM_0268, HSM_0270, HSM_0274, HSM_0598, HSM_0708, HSM_0749, HSM_0938, HSM_1022, HSM_1160, HSM_1191, HSM_1212, HSM_1257, HSM_1542, HSM_1571, HSM_1667, HSM_1728, HSM_1730, HSM_1736, HSM_1737, HSM_1741, HSM_1793 and HSM_1889. In a particular embodiment, the engineered *H. somni* strain has an identical attenuated phenotype as compared with TK #34.

Now that Applicants have disclosed these sufficient sets of attenuating gene deletions, the skilled person will appreciate that only non-routine works remains to determine which sub-combinations of these gene deletions are necessary to produce comparably- or equivalently-attenuated *H. somni* vaccine strains.

In another embodiment, the composition may further comprise at least one additional antigen associated with or derived from a bovine pathogen other than *H. somni*.

In an embodiment, the at least one or more additional antigen(s) is capable of eliciting in a cattle an immune response against *H. somni*, bovine respiratory disease complex (BRDC), bovine respiratory syncytial virus (BRSV), bovine viral diarrhea (BVD), bovine parainfluenza 3 (PI3), infectious bovine rhinotracheitis (IBR), bovine herpesvirus-1 (BHV-1), bluetongue disease virus (BTV), or any other pathogen capable of infecting and causing illness or susceptibility to illness in a bovine.

In another aspect, the invention provides a method of vaccinating an animal comprising administration of at least one of the disclosed immunological compositions comprising the attenuated *H. somni* strains.

In an embodiment, the *H. somni* vaccines further comprise an adjuvant. In a particular embodiment, the adjuvant comprises whole bacteria and/or bacteria, including *clostridium, H. somni, Mannheimia, Pasteurella, Histophilus, Salmonella, Escherichia coli*, or combinations and/or variations thereof. In several embodiments, the adjuvant increases the animal's production of IgM, IgG, IgA, and/or combinations thereof.

In another embodiment, the invention provides an attenuated *Histophilus somni* (*H. somni*) strain, which is capable of providing a safe and effective immune response in a bovine animal against *H. somni*, or diseases caused by *H. somni*; wherein the attenuated strain lacks, in its genomic sequence, a minimum number of virulence factor-encoding genes, relative to a reference virulent *H. somni* strain, to render the attenuated strain incapable of causing infection in the bovine animal.

In an embodiment, the reference virulent strain comprises a genomic DNA sequence, which encodes at least about 99% of the same genes as does the sequence as set forth in SEQ ID NO:2. In other embodiments, the attenuated strain encodes at least about 99% of the same genes as does the sequence as set forth in SEQ ID NO:1, 3, 4, or 5. In a particular embodiment, the attenuated strain(s) expresses any virulence factor gene at a level about equal to, or lower than (including an undetectable level), the level of the corresponding virulence gene expressed by an attenuated strain having for its genome the sequence as set forth in SEQ ID NO:1, 3, 4, or 5.

In a particular embodiment, the attenuated strain lacks at least about 99% of the same genes, relative to *H. somni* strain 2336, as does *H. somni* strain #4. In this embodiment, strain 2336 comprises a genomic sequence, which encodes at least about 99% of the same genes as does the sequence as set forth in SEQ ID NO:6; and strain #4 comprises a genomic sequence, which encodes at least about 99% of the same genes as does the sequence as set forth in SEQ ID NO:1.

In a particular embodiment, the attenuated strain is the #4 isolate (i.e. TK #4), which is deposited at the ATCC under the designation PTA-121029. In another embodiment, the attenuated strain is the #42 isolate (i.e. TK #42), which is deposited at the ATCC under the designation PTA-121030.

In another aspect, the invention provides immunological compositions comprising any of the attenuated strains described herein. In an embodiment, the composition comprises an attenuated strain, which encodes at least about 99% of the same genes as does the sequence as set forth in SEQ ID NO:1, 3, 4 or 5.

In one particular embodiment, the attenuated strain encodes at least about 99% of the same genes as does the sequence as set forth in SEQ ID NO:1. In a related embodiment, the attenuated strain encodes all the same genes as does the sequence as set forth in SEQ ID NO:1.

In one embodiment, the attenuated strain encodes at least about 99% of the same genes as does the sequence as set forth in SEQ ID NO:4. In a related embodiment, the attenuated strain encodes all the same genes as does the sequence as set forth in SEQ ID NO:4.

In still another embodiment, the attenuated strain encodes at least about 99% of the same genes as does the sequence as set forth in SEQ ID NO:3. In a related embodiment, the attenuated strain encodes all the same genes as does the sequence as set forth in SEQ ID NO:3.

In yet another embodiment, the attenuated strain encodes at least about 99% of the same genes as does the sequence as set forth in SEQ ID NO:5. In related embodiment, the attenuated strain encodes all the same genes as does the sequence as set forth in SEQ ID NO:5.

In an embodiment, the immunological composition further comprises a pharmaceutically or veterinary acceptable vehicle, diluent or excipient.

In a particular embodiment, immunological composition is capable of eliciting in a bovine animal a protective immune response, which protects the bovine against a subsequent exposure to a virulent *H. somni* strain.

In another embodiment, the immunological composition further comprises at least one or more additional antigen, which is capable of eliciting in a bovine animal a pathogen-specific immune response. In a particular embodiment, the at least one or more additional antigen elicits in the bovine an immune response sufficient to protect the animal from a subsequent exposure to the pathogen from which the antigen was derived. Thus, if a bovine PI3 antigen is included as a component of the immunological composition, the composition should elicit a protective immune response.

In another embodiment, the additional antigen is capable of eliciting in a bovine animal an immune response, which will enhance the animal's immune response against a subsequent exposure to Bovine Respiratory Disease Complex, BRSV, BVD, PI3 or any other pathogen capable of infecting and causing illness or susceptibility to illness in a bovine animal. For example, a BRSV antigen will provide protection against a subsequent exposure to virulent BRSV.

In another aspect, the invention provides a method of vaccinating a bovine animal comprising the step of administering to the bovine animal at least one dose of an immunological composition as herein described.

By "antigen" or "immunogen" means a substance that induces a specific immune response in a host animal. The antigen may comprise a whole organism, killed, attenuated or live; a subunit or portion of an organism; a recombinant vector containing an insert with immunogenic properties; a piece or fragment of DNA capable of inducing an immune response upon presentation to a host animal; a polypeptide, an epitope, a hapten, or any combination thereof. Alternately, the immunogen or antigen may comprise a toxin or antitoxin.

The terms "protein", "peptide", "polypeptide" and "polypeptide fragment" are used interchangeably herein to refer to polymers of amino acid residues of any length. The polymer can be linear or branched, it may comprise modified amino acids or amino acid analogs, and it may be interrupted by chemical moieties other than amino acids. The terms also encompass an amino acid polymer that has been modified naturally or by intervention; for example disulfide bond formation, glycosylation, lipidation, acetylation, phosphorylation, or any other manipulation or modification, such as conjugation with a labeling or bioactive component.

The term "immunogenic or antigenic polypeptide" as used herein includes polypeptides that are immunologically active in the sense that once administered to the host, it is able to evoke an immune response of the humoral and/or cellular type directed against the protein. Preferably the protein fragment is such that it has substantially the same immunological activity as the total protein. Thus, a protein fragment according to the invention comprises or consists essentially of or consists of at least one epitope or antigenic determinant. An "immunogenic" protein or polypeptide, as used herein, includes the full-length sequence of the protein, analogs thereof, or immunogenic fragments thereof. By "immunogenic fragment" is meant a fragment of a protein which includes one or more epitopes and thus elicits the immunological response described above. Such fragments can be identified using any number of epitope mapping techniques, well known in the art. See, e.g., Epitope Mapping Protocols in Methods in Molecular Biology, Vol. 66 (Glenn E. Morris, Ed., 1996). For example, linear epitopes may be determined by e.g., concurrently synthesizing large numbers of peptides on solid supports, the peptides corresponding to portions of the protein molecule, and reacting the peptides with antibodies while the peptides are still attached to the supports. Such techniques are known in the art and described in, e.g., U.S. Pat. No. 4,708,871; Geysen et al., 1984; Geysen et al., 1986. Similarly, conformational epitopes are readily identified by determining spatial conformation of amino acids such as by, e.g., x-ray crystallography and 2-dimensional nuclear magnetic resonance. See, e.g., Epitope Mapping Protocols, supra. Methods especially applicable to the proteins of *T. parva* are fully described in PCT/US2004/022605 incorporated herein by reference in its entirety.

As discussed herein, the invention encompasses active fragments and variants of the antigenic polypeptide. Thus, the term "immunogenic or antigenic polypeptide" further contemplates deletions, additions and substitutions to the sequence, so long as the polypeptide functions to produce an immunological response as defined herein. The term "conservative variation" denotes the replacement of an amino acid residue by another biologically similar residue, or the replacement of a nucleotide in a nucleic acid sequence such that the encoded amino acid residue does not change or is another biologically similar residue. In this regard, particularly preferred substitutions will generally be conservative in nature, i.e., those substitutions that take place within a family of amino acids. For example, amino acids are generally divided into four families: (1) acidic—aspartate and glutamate; (2) basic—lysine, arginine, histidine; (3) non-polar—alanine, valine, leucine, isoleucine, proline, phenylalanine, methionine, tryptophan; and (4) uncharged polar—glycine, asparagine, glutamine, cystine, serine, threonine, tyrosine. Phenylalanine, tryptophan, and tyrosine are sometimes classified as aromatic amino acids. Examples of conservative variations include the substitution of one hydrophobic residue such as isoleucine, valine, leucine or methionine for another hydrophobic residue, or the substitution of one polar residue for another polar residue, such as the substitution of arginine for lysine, glutamic acid for aspartic acid, or glutamine for asparagine, and the like; or a similar conservative replacement of an amino acid with a structurally related amino acid that will not have a major effect on the biological activity. Proteins having substantially the same amino acid sequence as the reference molecule but possessing minor amino acid substitutions that do not substantially affect the immunogenicity of the protein are, therefore, within the definition of the reference polypeptide. All of the polypeptides produced by these modifications are included herein. The term "conservative variation" also includes the use of a substituted amino acid in place of an unsubstituted parent amino acid provided that antibodies raised to the substituted polypeptide also immunoreact with the unsubstituted polypeptide.

The term "epitope" refers to the site on an antigen or hapten to which specific B cells and/or T cells respond. The term is also used interchangeably with "antigenic determinant" or "antigenic determinant site". Antibodies that recognize the same epitope can be identified in a simple immunoassay showing the ability of one antibody to block the binding of another antibody to a target antigen.

An "immunological response" to a composition or vaccine is the development in the host of a cellular and/or antibody-mediated immune response to a composition or vaccine of interest. Usually, an "immunological response" includes but is not limited to one or more of the following effects: the production of antibodies, B cells, helper T cells, and/or cytotoxic T cells, directed specifically to an antigen or antigens included in the composition or vaccine of interest. Preferably, the host will display either a therapeutic or protective immunological response such that resistance to new infection will be enhanced and/or the clinical severity of the disease reduced. Such protection will be demonstrated by either a reduction or lack of symptoms and/or clinical disease signs normally displayed by an infected host, a quicker recovery time and/or a lowered viral titer in the infected host.

By "animal" is intended mammals, birds, and the like. Animal or host as used herein includes mammals and human. The animal may be selected from the group consisting of equine (e.g., horse), canine (e.g., dogs, wolves, foxes, coyotes, jackals), feline (e.g., lions, tigers, domestic cats, wild cats, other big cats, and other felines including cheetahs and lynx), ovine (e.g., sheep), bovine (e.g., cattle, calves, steers, bulls), porcine (e.g., pig), avian (e.g., chicken, duck, goose, turkey, quail, pheasant, parrot, finches, hawk, crow, ostrich, emu and cassowary), primate (e.g., prosimian, tarsier, monkey, gibbon, ape), ferrets, seals, and fish. The term "animal" also includes an individual animal in all stages of development, including newborn, embryonic and fetal stages.

Unless otherwise explained, all technical and scientific terms used herein have the same meaning as commonly understood by one of ordinary skill in the art to which this disclosure belongs. The singular terms "a", "an", and "the" include plural referents unless context clearly indicates otherwise. Similarly, the word "or" is intended to include "and" unless the context clearly indicate otherwise.

It is noted that in this disclosure and particularly in the claims and/or paragraphs, terms such as "comprises", "comprised", "comprising" and the like can have the meaning attributed to it in U.S. patent law; e.g., they can mean "includes", "included", "including", and the like; and that terms such as "consisting essentially of" and "consists essentially of" have the meaning ascribed to them in U.S. patent law, e.g., they allow for elements not explicitly recited, but exclude elements that are found in the prior art or that affect a basic or novel characteristic of the invention.

Compositions

The present invention relates to a H. somni vaccine or composition which may comprise an attenuated H. somni strain and a pharmaceutically or veterinarily acceptable carrier, excipient, or vehicle, which elicits, induces or stimulates a response in an animal.

The term "nucleic acid" and "polynucleotide" refers to RNA or DNA that is linear or branched, single or double stranded, or a hybrid thereof. The term also encompasses RNA/DNA hybrids. The following are non-limiting examples of polynucleotides: a gene or gene fragment, exons, introns, mRNA, tRNA, rRNA, ribozymes, cDNA, recombinant polynucleotides, branched polynucleotides, plasmids, vectors, isolated DNA of any sequence, isolated RNA of any sequence, nucleic acid probes and primers. A polynucleotide may comprise modified nucleotides, such as methylated nucleotides and nucleotide analogs, uracyl, other sugars and linking groups such as fluororibose and thiolate, and nucleotide branches. The sequence of nucleotides may be further modified after polymerization, such as by conjugation, with a labeling component. Other types of modifications included in this definition are caps, substitution of one or more of the naturally occurring nucleotides with an analog, and introduction of means for attaching the polynucleotide to proteins, metal ions, labeling components, other polynucleotides or solid support. The polynucleotides can be obtained by chemical synthesis or derived from a microorganism.

The term "gene" is used broadly to refer to any segment of polynucleotide associated with a biological function. Thus, genes include introns and exons as in genomic sequence, or just the coding sequences as in cDNAs and/or the regulatory sequences required for their expression. For example, gene also refers to a nucleic acid fragment that expresses mRNA or functional RNA, or encodes a specific protein, and which includes regulatory sequences.

An "isolated" biological component (such as a nucleic acid or protein or organelle) refers to a component that has been substantially separated or purified away from other biological components in the cell of the organism in which the component naturally occurs, for instance, other chromosomal and extra-chromosomal DNA and RNA, proteins, and organelles. Nucleic acids and proteins that have been "isolated" include nucleic acids and proteins purified by standard purification methods. The term also embraces nucleic acids and proteins prepared by recombinant technology as well as chemical synthesis.

The term "conservative variation" denotes the replacement of an amino acid residue by another biologically similar residue, or the replacement of a nucleotide in a nucleic acid sequence such that the encoded amino acid residue does not change or is another biologically similar residue. In this regard, particularly preferred substitutions will generally be conservative in nature, as described above.

The term "recombinant" means a polynucleotide with semisynthetic, or synthetic origin which either does not occur in nature or is linked to another polynucleotide in an arrangement not found in nature.

"Heterologous" means derived from a genetically distinct entity from the rest of the entity to which it is being compared. For example, a polynucleotide may be placed by genetic engineering techniques into a plasmid or vector derived from a different source, and is a heterologous polynucleotide. A promoter removed from its native coding sequence and operatively linked to a coding sequence other than the native sequence is a heterologous promoter.

The polynucleotides of the invention may comprise additional sequences, such as additional encoding sequences within the same transcription unit, controlling elements such as promoters, ribosome binding sites, 5'UTR, 3'UTR, transcription terminators, polyadenylation sites, additional transcription units under control of the same or a different promoter, sequences that permit cloning, expression, homologous recombination, and transformation of a host cell, and any such construct as may be desirable to provide embodiments of this invention.

Methods of use and Article of Manufacture

The present invention includes the following method embodiments. In an embodiment, a method of vaccinating an animal comprising administering a composition comprising an attenuated *H. somni* strain and a pharmaceutical or veterinarily acceptable carrier, excipient, or vehicle to an animal is disclosed. In one aspect of this embodiment, the animal is a bovine.

In one embodiment of the invention, a prime-boost regimen can be employed, which is comprised of at least one primary administration and at least one booster administration using at least one common polypeptide, antigen, epitope or immunogen. Typically the immunological composition or vaccine used in primary administration is different in nature from those used as a booster. However, it is noted that the same composition can be used as the primary administration and the booster administration. This administration protocol is called "prime-boost".

A prime-boost regimen comprises at least one prime-administration and at least one boost administration using at least one common polypeptide and/or variants or fragments thereof. The vaccine used in prime-administration may be different in nature from those used as a later booster vaccine. The prime-administration may comprise one or more administrations. Similarly, the boost administration may comprise one or more administrations.

The dose volume of compositions for target species that are mammals, e.g., the dose volume of cattle or bovine compositions, based on bacterial antigens, is generally between about 0.1 to about 2.0 ml, between about 0.1 to about 1.0 ml, and between about 0.5 ml to about 1.0 ml.

The efficacy of the vaccines may be tested about 3 to 5 weeks after the last immunization by challenging animals, such as bovine, with a virulent, heterologous strain of *H. somni*. The animal may be challenged intra-nasally, intra-tracheally, and/or trans-tracheally. Samples from nasal passages, trachea, lungs, brain, and/or mouth may be collected before and post-challenge and may be analyzed for the presence of *H. somni*-specific antibody.

The compositions comprising the attenuated viral strains of the invention used in the prime-boost protocols are contained in a pharmaceutically or veterinary acceptable vehicle, diluent or excipient. The protocols of the invention protect the animal from *H. somni* and/or prevent disease progression in an infected animal.

The various administration is preferably a one-shot dosage, but multiple dosages could be carried out 1 to 6 weeks apart. A preferred time interval is 2 to 3 weeks, and an annual booster is also envisioned. In an embodiment, the compositions are administered to calves that are between about 5 to about 6 weeks old. In another embodiment, the calves may be about 3 to about 4 weeks old.

It should be understood by one of skill in the art that the disclosure herein is provided by way of example and the present invention is not limited thereto. From the disclosure herein and the knowledge in the art, the skilled artisan can determine the number of administrations, the administration route, and the doses to be used for each injection protocol, without any undue experimentation.

Another embodiment of the invention is a kit for performing a method of eliciting or inducing an immunological or protective response against *H. somni* in an animal comprising an attenuated *H. somni* immunological composition or vaccine and instructions for performing the method of delivery in an effective amount for eliciting an immune response in the animal.

Another embodiment of the invention is a kit for performing a method of inducing an immunological or protective response against *H. somni* in an animal comprising a composition or vaccine comprising an attenuated *H. somni* strain of the invention, and instructions for performing the method of delivery in an effective amount for eliciting an immune response in the animal.

The pharmaceutically or veterinarily acceptable carriers or vehicles or excipients are well known to one skilled in the art. For example, a pharmaceutically or veterinarily acceptable carrier or vehicle or excipient can be a 0.9% NaCl (e.g., saline) solution or a phosphate buffer. Other pharmaceutically or veterinarily acceptable carrier or vehicle or excipients that can be used for methods of this invention include, but are not limited to, poly-(L-glutamate) or polyvinylpyrrolidone. The pharmaceutically or veterinarily acceptable carrier or vehicle or excipients may be any compound or combination of compounds facilitating the administration of the attenuated bacteria. Doses and dose volumes are herein discussed in the general description and can also be determined by the skilled artisan from this disclosure read in conjunction with the knowledge in the art, without any undue experimentation.

Though the disclosed results were obtained without the use of an adjuvant, the immunological compositions and vaccines may further comprise or consist essentially of an appropriate adjuvant. Suitable adjuvants for use in the practice of the present invention are (1) polymers of acrylic or methacrylic acid, maleic anhydride and alkenyl derivative polymers, (2) immunostimulating sequences (ISS), such as oligodeoxyribonucleotide sequences having one or more non-methylated CpG units (Klinman et al., 1996; WO98/16247), (3) an oil in water emulsion, such as the SPT emulsion described on page 147 of "Vaccine Design, The Subunit and Adjuvant Approach" published by M. Powell, M. Newman, Plenum Press 1995, and the emulsion MF59 described on page 183 of the same work, (4) cationic lipids containing a quaternary ammonium salt, e.g., DDA (5) cytokines, (6) aluminum hydroxide or aluminum phosphate, (7) saponin or (8) other adjuvants discussed in any document cited and incorporated by reference into the instant application, or (9) any combinations or mixtures thereof.

In an embodiment, adjuvants include those which promote improved absorption through mucosal linings. Some examples include MPL, LTK63, toxins, PLG microparticles and several others (Vajdy, M. Immunology and Cell Biology (2004) 82, 617-627). In an embodiment, the adjuvant may be a chitosan (Van der Lubben et al. 2001; Patel et al. 2005; Majithiya et al. 2008; U.S. Pat. No. 5,980,912).

REFERENCES

Alekshun, M. N. and Levy, S. B. 2007. Molecular mechanisms of antibacterial multidrug resistance. *Cell*. 128(6): 1037-1050.

Asgarali, A. Stubbs, K. A., Oliver, A., Vocaldo, D. J., and Mark, B. L. 2009. Inactivation of the Glycoside Hydrolase NagZ Attenuates Antipseudomonal β-Lactam Resistance in *Pseudomonas aeruginosa*. *Antimicrobial Agents and Chemotherapy.* 53(6):2274-2282.

Aubry, C et al. 2011. OatA, a peptidoglycan O-acetyltransferase involved in *Listeria monocytogenes* immune escape, is critical for virulence. *J. Infect. Dis.* 204(5):731-740.

Babcock, A. H. 2010. Epidemiology of Bovine Respiratory Disease and Mortality in Commercial Feedlots. Kansas State University (doctoral dissertation).

Berghaus, L. J., Corbeil, L. B., Berghaus, R. D., Kalina, W. V., Kimball, R. A., and Gershwin, L. J. 2006. Effects of dual vaccination for bovine respiratory syncytial virus and *Haemophilus somnus* on immune responses. Vaccine. 24:6018-6027.

Brown, N. L., Stoyanov, J. V., Kidd, S. P., and Hobman J. L. 2003. The MerR family of transcriptional regulators. *FEMS Microbiology Reviews.* 27:145-163.

Challacombe et al. 2007. Complete Genome Sequence of *Haemophilus somnus* (*Histophilus somni*) strain 129Pt and Comparison to *Haemophilus ducreyi* 35000HP and *Haemophilus influenzae* Rd. Journal of Bacteriology 189 (5); p 1890-1898.

Corbeil, L. B. et. al. 1985. Serum susceptibility of *Haemophilus somnus* from bovine clinical cases and carriers. *Journal of Clinical Microbiology.* 22(2):192-198.

Cox, A. D., Howard, M. D., Brisson, J.-R., Van Der Zwan M., Thibault, P., Perry, M. B., and Inzana, T. J. 1998. Structural analysis of the phase-variable lipooligosaccharide from *Haemophilus somnus* strain 738. European Journal of Biochemistry. 97:253(2):507-516.

Daines D. A., Jarisch J., and Smith A. L. 2004. Identification and characterization of a nontypeable *Haemophilus influenzae* putative toxin-antitoxin locus. *BMC Microbiol.* July 26; 4:30.

Duff and Gaylean 2011. Recent Advances in Management of Highly Stressed, Newly Received Feedlot Cattle. *Journal of Animal Science.* 85; p 823-840.

Garbe, J. and Collin, M. 2012. Bacterial Hydrolysis of Host Glycoproteins—Powerful Protein Modification and Efficient Nutrient Acquisition. *Journal of Innate Immunity.* 4:121-131.

Fulton, R. W. et al. 2002. Evaluation of Health Status of Calves and the Impact on Feedlot Performances: Assessment of a Retained Ownership Program for Postweaning Calves. *Can. J. Vet. Res.* 66, 173-180.

Geertsema, R. S., Worby, C., Kruger, R. P., Tagawa, Y., Russo, R., Herdman, D. S., Lo, K. Kimball, R. A., Dixon, J., and Corbeil, L. B. 2008. Protection of mice against *H. somni* septicemia by vaccination with recombinant immunoglobulin binding protein subunits. Vaccine. 26:4506-4512.

Gershwin, L. J., Berghaus, L. J. Arnold, K., Anderson, M. L., and Corbeil, L. B. 2005. Immune mechanisms of pathogenic synergy in concurrent bovine pulmonary infection with *Haemophilus somnus* and bovine respiratory syncytial virus. 2005. Veterinary Immunology and Immunopathology. 107:119-130.

Griffin, D. 2010, Bovine Pasteurellosis and other Bacterial Infections of the Respiratory Tract. *Vet. Clin. North Am. Food Anim. Pract.* 26(1); p57-71.

Griffin, D. 1997. Economic Impact Associated with Respiratory Disease in Beef Cattle. *Vet. Clin. North Am. Food Anim. Pract.* 13; p367-377.

Guzmán-Brambila, C et al. 2012. Two Outer Membrane Lipoproteins from *H. somni* are Immunogenic in Rabbits and Sheep and Induce Protection against Bacterial Challenge in Mice. *Clinical and Vaccine Immunology.* 19(11): 1826-1832.

Huston, W. M., Jennings, M. P., McEwan, A. G. 2002. The multicopper oxidase of *Pseudomonas aeruginosa* is a ferroxidase with a central role in iron acquisition. *Molecular Microbiology.* 45(6):1741-1750.

Kahler, C. et. al. 1996. IgtF and RfaK constitute the lipooligosaccharide ice (inner core extension) biosynthesis operon of *N. meningitidis*. *J. Bacteriology.* December 6677-6684.

Kjos, M., Snipen, L., Salehian, Z., Nes, I. F., and Diep, D. B. 2010. The Abi proteins and their involvement in bacteriocin self-immunity. *Journal of Bacteriology.* 192 (8):2068-2076.

Korczak et. al. 2004. Phylogeny of the Family Pasteurellaceae based on rpoB sequences. International Journal of Systemic and Evolutionary Microbiology. 54; p 1393-1399.

Liu, T. et. al. 2008. Immunological responses against *S. enterica* serovar *Typhimurium* Braun lipoprotein and lipid A mutant strains in Swiss-Webster mice: Potential use as live-attenuated vaccines. *Microbial Pathogenesis.* 44(3): 224-237.

Perera, I. C. and Grove, A. 2010. Molecular Mechanisms of Ligand-Mediated Attenuation of DNA Binding by MarR Family Transcriptional Regulators. *JMCB.* 2(5):243-254.

O'Toole et al. 2009. Diagnostic Exercise: Myocarditis due to *Histophilus somni* in Feedlot and Backgrounded Cattle. *Veterinary Pathology.* 46; p 1015-1017.

Ramos, J. L., Martinez-Bueno, M., Molina-Henares, A. J., Terin, W., Watanabe, K., Zhang, X., Trinidad Gallegos, M., Brennan, R., and Tobes, R. 2005. The TetR family of Transcriptional Repressors. *MMBR.* 69:326-356.

Ribble et al. 1988. Efficacy of Immunization of Feedlot Cattle with a Commercial *Haemophilus* somnus bacterin. *Canadian Journal of Veterinary Research.* 52; p 191-198.

Schäfer, A et al. 1994. Cloning and characterization of a DNA region encoding a stress-sensitive restriction system from *Corynebacterium glutamicum* ATCC 13032 and analysis of its role in intergenic conjugation with *E. coli*. *J. Bacteriology.* 176(23):7309-7319.

Ward et al. 2006. *Haemophilus somnus* (*Histophilus somni*) in Bighorn Sheep. *Canadian Journal of Veterinary Research.* 70; p. 34-42.

The invention will now be further described by the following non-limiting examples.

EXAMPLES

The literature has reported on a number of *H. somni* virulence factors. No single virulence factor seems to dominate the role of the pathogen, but instead, several factors appear to act in concert to make a given isolate virulent. Seven virulence factors were identified: DR2 (a direct repeat that contains a conserved cytotoxic Fic motif within the IbpA domain involved in resistance to serum), hsst-I (CMP-Neu5Ac-β-Gal-α-(2-3)-sialyltransferase, where sialylation of the lipooligosaccharide (LOS) has been shown to inhibit antibody binding), lob2b (encoding a glycotransferase involved in LOS synthesis), nan lyase (N-acetylneuraminate lyase, involved in sialic acid metabolism), nan epimerase (N-acetylmannosamine-6-phosphate-2-epimerase, involved in the transport and metabolism of carbohydrates), luxS (involved in AI-2 quorum sensing), and uspE (a universal stress protein necessary for cell motility and aggregation in biofilm formation). Primers were designed to amplify each of these genes and PCR reaction parameters were optimized.

Fifty isolates were selected for screening. The criteria for isolate selection was they had to be isolated within approximately one year of the start of this study and had to be from diverse geographical locations or from cases of particular interest with high possible genotypic diversity. The purpose of this was to look at the most current isolates indicative of *H. somni* in the field and also to try and screen as much diversity as possible. Isolates were evaluated on their growth and colony appearance, in addition to carrying out the PCR reactions defined for each virulence factor of interest. The PCR reactions were visualized on a 1% agarose gel. Following the selection of isolates based on growth, colony appearance, and PCR results, animal models were identified and used to evaluate isolates of interest.

Example 1

*H. somni* Mouse Challenge Model Development

Based on growth, geographical diversity, and sequence information, 21 isolates were selected for evaluation in mice (Table 1).

TABLE 1

Isolates evaluated for a naturally occurring *H. somni* vaccine candidate.

| Isolate # | Case # | Location | SEQ ID NO |
|---|---|---|---|
| TK #1 | 12-0137-7 | Grandview, ID | |
| TK #2 | 12-0137-8 | Grandview, ID | |
| TK #3 | 12-0137-9 | Grandview, ID | |
| TK #4 | 12-0137-4 | Grandview, ID | 1 |
| TK #5 | 12-0137-6 | Grandview, ID | |
| TK #14 | 12-0137-13 | Grandview, ID | |
| TK #15 | 12-0137-11 | Grandview, ID | |
| TK #21 | 11-4134-1 | Marshall, MN | 2 |
| TK #22 | 11-4601-1 | Great Bend, KS | |
| TK #24 | 11-2909-2 | Carlisle, KY | |
| TK #28 | 11-0125-1 | Plainview, TX | 3 |
| TK #30 | 11-3169-2 | Las Animas, CO | |
| TK #33 | 11-3454-4 | Fairmont, MN | |
| TK #34 | 11-3452-2 | Fairmont, MN | 5 |
| TK #37 | 12-0370-1 | Cresco, IA | |
| TK #40 | 11-0012-1 | Gettysburg, SD | |
| TK #41 | 11-4378-2 | Gettysburg, SD | |
| TK #42 | 11-0141-1 | Parkston, SD | 4 |
| TK #44 | 11-0263-1 | Mesquite, NV | |
| TK #47 | 11-4312-1 | Sioux Center, IA | |
| 2336 | 2336 | Public WT (Control) | 6 |

Isolates stored at −80° C. were streak-plated onto Columbia+5% Sheep Blood agar plates (CSBA) (Becton Dickinson, Franklin Lakes, N.J.). The plates were incubated at 37° C. with 5% $CO_2$. After 18 hours of growth, the plates were washed with 2 mL DPBS and the resulting solution was diluted with additional DPBS and mixed 1:1 of culture and FBS (pre-warmed to RT) to obtain a final concentration of between $5\times10^8$ and $1\times10^9$ CFU/dose. After the FBS was added, the cultures were incubated for 5 min. at RT to up-regulate *H. somni* virulence factors, and then placed on ice.

Each group of ten, 18-20 g NSA: CF-1 mice (Harlan Sprague Dawley)/isolate were injected with 0.5 cc intraperitoneally (IP) with its assigned isolate. A control group of ten mice was given DPBS+FBS. Filter-tops were placed on the top of each of the mice cages with one cage equaling ten mice/isolate. The isolates were diluted and plated, and plates were incubated at 37° C. with 5% $CO_2$ for two days. Plates were counted and the actual CFU/dose was determined for each isolate. Additionally, five mice were injected SQ with isolates 2336 or TK #33, to determine if this route of administration would be a viable alternative (for assessing virulence) to the IP route. After challenge, mice were observed daily for mortality.

Most isolates yielded mid to upper 8 logs CFU/dose. The SQ method proved to be an unsuccessful method for challenging mice. Isolates TK #4, TK #24, TK #14, the controls, and 2336 resulted in the least percent mortality, while isolates TK #1, TK #2, TK #21, TK #28, and TK #30 resulted in the greatest percent mortality (Table 2).

TABLE 2

Percent mortality when 18-20 g mice were challenged with plate-grown isolates.

| Isolate # | Route | CFU/dose | % Mortality |
|---|---|---|---|
| TK #33 | SQ | $3.7\times10^8$ | 0 |
| Controls | IP | 0 | 0 |
| 2336 | IP | $1.7\times10^9$ | 0 |
| 2336 | SQ | $1.7\times10^9$ | 0 |
| TK #4 | IP | $7.6\times10^8$ | 10 |
| TK #14 | IP | $8.7\times10^8$ | 10 |
| TK #24 | IP | $5.5\times10^8$ | 10 |
| TK #34 | IP | $7.2\times10^8$ | 20 |
| TK #42 | IP | $5.9\times10^8$ | 20 |
| TK #5 | IP | $6.2\times10^8$ | 30 |
| TK #15 | IP | $7.5\times10^8$ | 30 |
| TK #33 | IP | $3.7\times10^8$ | 30 |
| TK #37 | IP | $7.3\times10^8$ | 30 |
| TK #41 | IP | $9.9\times10^8$ | 30 |
| TK #3 | IP | $8.6\times10^8$ | 40 |
| TK #22 | IP | $8.0\times10^8$ | 40 |
| TK #40 | IP | $9.9\times10^8$ | 40 |
| TK #44 | IP | $9.0\times10^8$ | 40 |
| TK #47 | IP | $7.0\times10^8$ | 40 |
| TK #1 | IP | $8.0\times10^8$ | 50 |
| TK #2 | IP | $8.7\times10^8$ | 50 |
| TK #28 | IP | $7.1\times10^8$ | 50 |
| TK #30 | IP | $4.8\times10^8$ | 50 |
| TK #21 | IP | $5.1\times10^8$ | 80 |

Challenge Model. Two studies were conducted to determine the ideal CFU/dose and challenge culture preparation for mice that would be larger in vaccination-challenge studies than in the previous study (i.e. taking into account the three weeks' growth between vaccination and challenge). For the first study, forty, 25-30 g NSA: CF-1 mice (Harlan Sprague Dawley) were used. *H. somni* Isolate TK #21 was streak-plated onto CSBA. After ~24 hours of growth at 37° C. with 5% $CO_2$ the isolate was lawned onto additional CSBAs and grown under the same conditions for 18-20 hours. Each plate was washed with 2 mL DPBS and the liquid was collected. Dilutions from the original plate wash were made to create two additional solutions varying in CFU/dose. Each dilution was mixed 1:1 with FBS to achieve final concentrations of challenge fluids ranging from low 8 logs to low 9 logs/dose. Control fluids were created with 1:1 DPBS and FBS. All FBS added cultures were incubated at room temp. for 5 min. and then placed on ice. Mice were challenged with 0.5 cc IP and monitored for mortality after challenge. The challenge cultures were diluted and plated to determine the ideal CFU/dose required for maximum mortality.

When the challenge culture TK #21 was grown on plates and mice were larger (25-30 g), to account for their expected size three-weeks post-vaccination, the greatest percent mortality was achieved at $5.7\times10^8$ CFU/dose (Table 3).

TABLE 3

Percent mortality when 25-30 g mice were challenged with plate-grown isolates.

| Group | Isolate | CFU/dose | % Mortality |
|---|---|---|---|
| 1 | TK #21 | $1.6 \times 10^9$ | 9.1 |
| 2 | TK #21 | $5.7 \times 10^8$ | 27.3 |
| 3 | TK #21 | $4.2 \times 10^8$ | 20 |
| 4 | Control | 0 | 0 |

A final challenge study was conducted with thirty, 25-30 g NSA: CF-1 mice (Harlan Sprague Dawley) to compare the difference between growing the challenge culture on plates (as is commonly done in the literature) or in broth. Similar as above, isolate TK #21 was removed from frozen storage and lawned onto additional plates. For the broth culture, a plate was washed with 2 mL Columbia broth and 50 µL was added to 25 mL pre-warmed Columbia broth. The culture was shaken vigorously after the culture wash was added and then placed on a shaker set to 37° C. and 250 rpm. Growth was monitored and the culture was stopped when we estimated the final challenge culture, with all fluids added, would contain mid-8 logs/dose. Also, a challenge culture was prepared by plate washing as above, with the culture diluted with DPBS to about the same concentration as the broth culture. Both the broth and plate cultures were mixed 1:1 with FBS and incubated for 5 min. at room temp. prior to being placed on ice. Eleven mice/method were challenged with 0.5 cc IP of the plate wash or the broth and 10 mice served as controls given a mixture of equal parts Columbia broth and DPBS, which was then mixed 1:1 with FBS. Mice were monitored for mortality post-challenge and dilutions and plating was completed to determine CFU/dose.

Greater mortality of 25-30 g mice occurred when mice were challenged with isolate #21 grown in broth compared to the same isolate grown on plates (Table 4). This result was unexpected, particularly considering the literature guided the skilled person away from growing *H. somni* in broth for use in a virulent challenge study (Berghaus et. al., 2006; Geertsema et. al., 2008; Gershwin et. al., 2005).

TABLE 4

| Percent mortality when 25-30 g mice were challenged with plate/broth-grown isolates. | | | |
|---|---|---|---|
| Method of Growth | Isolate | CFU/dose | % Mortality |
| Plates | TK #21 | $5.3 \times 10^8$ | 36.4 |
| Broth | TK #21 | $4.8 \times 10^8$ | 54.5 |
| — | Controls | — | 0 |

One hundred thirty NSA: CF-1 mice, 18-20 g were purchased from Harlan Sprague Dawley. Five *H. somni* isolates (TK #42, TK #14, TK #4, TK #24, and TK #34) were selected from the previous studies as vaccine candidates. These isolates were removed from storage and streaked onto CSBA where they were incubated for ~24 hours at 37° C. and 5% $CO_2$. The isolates were transferred to new CSBAs and lawned onto the plate surface where they were allowed to grow for –18 hours. The plates were washed with 2 mL Columbia broth. For isolates TK #42 and TK #34, 100 μL of plate wash was added to 25 mL of Columbia broth, and for isolates TK #4, TK #14, and TK #24, 50 μL of plate wash was added to 25 mL Columbia broth, based on previous studies involving the growth of these isolates.

The cultures were incubated at 37° C. and 200 rpm. Growth of the isolates was monitored and cultures were removed from incubation and diluted with Columbia broth to contain approximately $1\times10^8$ CFU/dose and a 1:10 dilution of this was made to make another vaccine estimated at $1\times10^7$ CFU/dose, for each isolate. A control group was vaccinated with sterile Columbia broth and another control group was vaccinated with the commercially available SOMUBAC® (Zoetis, inactivated *Histophilus* vaccine, adjuvanted with aluminum hydroxide, Kalamazoo, Mich.).

Each vaccine was maintained on ice after it was prepared and each group included 10 mice, with the exception of the Columbia Control group which included 6 mice. The vaccine was delivered SQ as 0.5 cc. After vaccination, the vaccines were diluted and plated to determine actual CFU/dose and mice were monitored daily for adverse reactions and/or death. Endotoxin involved in each vaccine was determined with the Limulus Amebocyte Lysate kit (Lonza, Allendale, N.J.).

Nineteen days after vaccination, mice were challenged with *H. somni* isolate TK #21. The wildtype was prepared for growth in broth similar as above, with the exception that 150 μL of plate wash was used to inoculate each of 2 flasks containing 75 mL pre-warmed Columbia broth each. The flasks were incubated at 37° C. and 250 rpm. The culture was removed from incubation, diluted, and mixed 1:1 with room temperature FBS to contain mid-8 logs/dose. The culture was incubated with the FBS at room temperature for 5 min. and placed on ice. The challenge product was dilution plated prior-to- and post-challenge to determine if the CFU/dose matched our estimate. Mice were administered 0.5 cc IP of the challenge culture and monitored daily for death.

Mice vaccinated with SOMUBAC® (Zoetis, inactivated *Histophilus* vaccine, adjuvanted with aluminum hydroxide), and isolates TK #34 and TK #22 at 8 logs, developed red injection site reactions. All isolates, with the exception of TK #22, provided some protection to mice prior to challenge, in comparison to the control group. Isolate TK #4 was effective at both vaccine doses, however, isolate TK #34 was best at 8 logs and isolates TK #24 and TK #42 were best at 7 logs. At both doses, isolate TK #14 provided some protection but less than the others (Table 5). Isolates TK #24 at 8 logs and TK #42 at 8 logs had one mouse of 10 die after vaccination, prior to challenge.

TABLE 5

| The percent mortality in mice vaccinated with a low virulence isolate and challenged with a high virulence isolate. | | | | |
|---|---|---|---|---|
| Isolate | Vaccine CFU/Dose | Vaccine EU/dose* | Challenge CFU/dose | % Mortality |
| TK #4 | $1.8 \times 10^7$ | — | $5.1 \times 10^8$ | 10 |
| TK #4 | $1.8 \times 10^8$ | 31,559 | $5.1 \times 10^8$ | 20 |
| TK #14 | $1.8 \times 10^7$ | — | $5.1 \times 10^8$ | 40 |
| TK #14 | $1.8 \times 10^8$ | 30,287 | $5.1 \times 10^8$ | 40 |
| TK #22 | $1.3 \times 10^7$ | — | $5.1 \times 10^8$ | 60 |
| TK #22 | $1.3 \times 10^8$ | 54,451 | $5.1 \times 10^8$ | 80 |
| TK #24 | $1.3 \times 10^7$ | — | $5.1 \times 10^8$ | 10 |
| TK #24 | $1.3 \times 10^8$ | 38,372 | $5.1 \times 10^8$ | 33 |
| TK #34 | $1.6 \times 10^7$ | — | $5.1 \times 10^8$ | 40 |
| TK #34 | $1.6 \times 10^8$ | 28,107 | $5.1 \times 10^8$ | 0 |
| TK #42 | $1.3 \times 10^7$ | — | $5.1 \times 10^8$ | 10 |
| TK #42 | $1.3 \times 10^8$ | 33,648 | $5.1 \times 10^8$ | 33 |
| SOMUBAC ® | — | — | $5.1 \times 10^8$ | 10 |
| Control | 0 | 2,307 | $5.1 \times 10^8$ | 67 |

*EU/dose = Endotoxin units/dose; EU/dose was only determined for the 8 log vaccines.

Example 2

H. somni Calf Challenge

Prior to testing the vaccine candidates, a calf challenge model had to be developed. For this study, twenty Holstein bull calves were used. Calves were challenged at 54 days-of-age using either isolate TK #21 or 153-3 (acquired from calves with confirmed clinical disease due to *H. somni*). The challenge culture was prepared in broth similar to above. To estimate the CFU/dose of the challenge culture, a previously established standard curve ($y=-5\times10^{-8}x+92.017$ ($x$=CFU/mL and y=% T (540 nm)) was used to determine the dilutions needed to achieve a final challenge concentration of ~$2.5\times10^8$ and $2.5\times10^9$ CFU/dose for each isolate. The culture was diluted with EBSS followed by the addition of a 1:1 ratio of FBS after which the cultures were incubated for 5 min. at room temp. The challenge cultures were placed on ice along with additional EBSS for chasing the challenge dose. For each of 4 calves per isolate and dose, 20 cc of challenge was administered trans-tracheally and was chased into the lungs with 60 cc of EBSS. Four animals remained as non-challenged controls, which were given 1:1 EBSS and FBS. The challenge culture was diluted and plated prior-to- and post-challenge to determine actual CFU administered. Clinical signs were rated and recorded daily by the same person as follows:

TABLE 6

Calf Challenge Clinical Signs Rating Criteria

| Rating | Criteria |
| --- | --- |
| | Attitude |
| 0 | Normal |
| 1 | Depressed |
| 2 | Moderately Depressed |
| 3 | Severely Depressed |
| | Anorexia |
| 0 | Normal |
| 1 | Little motivation to eat |
| 2 | No motivation to eat |
| 3 | No motivation to eat or interact → Humanely Euthanize |
| | Respiration Rate |
| 0 | Normal |
| 1 | Increased Respiration Rate |
| 2 | Labored Breathing |
| 3 | Labored Breathing and Wheezing |
| | Nasal Discharge |
| 0 | Normal |
| 1 | Small amount of unilateral discharge |
| 2 | Bilateral, excessive mucus discharge |
| 3 | Thick bilateral discharge |
| | Cough |
| 0 | Normal |
| 1 | Single Cough |
| 2 | Occasional spontaneous cough or repeated coughs |
| 3 | Repeated spontaneous coughs |
| | Ability to Rise or Walk |
| 0 | Normal |
| 1 | Rise with enticement and motivated to walk |
| 2 | Rise with enticement and no motivation to walk |
| 3 | No motivation to rise/walk → Humanely Euthanize |

The total clinical score was calculated for each animal by summing the ratings determined for each category. If an animal was found dead, or met the criteria of euthanasia, a necropsy was performed and the lungs removed. An attending veterinarian rated the lungs for % surface area lesions, and tissues were subjected to analysis. After 4 days, the remaining animals were euthanized and necropsied as above. Lung lesions were arcsine-transformed and analyzed using the "JMP Fit Y by X" function and means were separated with Student's t.

Twenty-four Holstein bull calves were divided into five pens containing five animals each for vaccination and 4 animals to serve as non-vaccinated controls. In addition, four animals from the challenge model's non-challenged group were kept alive given the calf vaccination-challenge study was scheduled to be challenged the following week. They were kept in a separate pen. These animals, referred to as controls from challenge model, were an additional experimental control to see if being in the same barn but not the same pen as challenged animals could affect the results when these animals were challenged. Vaccines were prepared as for mice using isolates TK #28, TK #42, TK #4, and TK #34. The vaccine cultures were prepared similarly to the above challenge culture without the addition of FBS. The vaccines were estimated to contain $5\times10^8$ CFU/dose and a dose was 2 cc, 1 cc administered in each calf nostril.

The vaccines were diluted and plated prior-to- and post-vaccination to determine the actual CFU/dose. Animal health was monitored post-vaccination. Nasal swabs and blood samples were collected from animals on day −17 (one day after arrival), day 0 (date of vaccination, calf age=35 days-old), day 14, day 21, and day 33 (date of challenge). Nasal swabs were submitted to the Newport Laboratories Diagnostic Lab for bacterial culture and blood samples were maintained for possible serology. All animals with the addition of the 4 control animals from the challenge model study, were challenged the same as above with an estimated $5\times10^9$ CFU/dose. Clinical signs, necropsies, lung lesions, bacterial culture, *Mycoplasma* PCR, and statistics were carried out as above with total clinical score and lung lesions also analyzed with JMP Fit Y by X.

For the challenge study, the actual plated CFU/dose was very close to the estimated $2.5\times10^9$ or $2.5\times10^8$ CFU/dose that was predicted. The animals challenged with isolate TK #21 were given $3.9\times10^9$ CFU/dose for the 9 log group and $2.9\times10^8$ CFU/dose for the 8 log group. The animals challenged with isolate 153-3 were given $1.8\times10^9$ CFU/dose for the 9 log group and $1.7\times10^8$ CFU/dose for the 8 log group.

More clinical signs of disease were observed for animals challenged with isolate TK #21 at 9 logs than any other challenge group (Table 7). In addition, more severe lung lesions were observed for animals challenged with isolate TK #21 than any other challenge group (FIG. 1). The majority of calves that had pneumonic lesions had *H. somni* recovered from the lung tissue. Throughout the study, *P. multocida* was recovered from the nasal swabs and the lung tissue, but did not appear to be a contributing cause of the disease symptoms, as animals did not show clinical signs of pneumonia until post-challenge. Also, many of the animals were confirmed positive or suspect for *M. bovis* in the lung tissue. As expected, no *M. bovoculi* was detected.

TABLE 7

The average sum of clinical signs rated during the challenge model study.

| Isolate | Average Clinical Score* |
| --- | --- |
| 153-3 (9 logs) | 0.75 |
| 153-3 (8 logs) | 0.25 |
| Controls | 0.00 |
| TK #21 (9 logs) | 7.00 |
| TK #21 (8 logs) | 1.75 |

*From the last rating taken of the animals prior to death.

The actual concentration of bacteria used for vaccination was close to the estimated $5 \times 10^8$ CFU/dose. *H. somni* was recovered only after vaccination with the live bacteria from two to three animals at each of the nasal swab collection dates of day 14, day 21, and day 33 post-vaccination. The nasal swabs demonstrated that *H. somni* can remain viable in the nasal passages for 21-33 days if not more (Table 8).

TABLE 8

Bacteria concentration and endotoxin administered to calves vaccinated intranasally with isolates TK #28, TK #42, TK #4, and TK #34, and the number of *H. somni* isolates recovered from the vaccinated animals throughout the study.

| Vaccine Isolate | Actual CFU/dose administered | Endotoxin Units/mL | Nasal Swab Recovery (day) of recovery)* |
|---|---|---|---|
| TK #28 | $3.90 \times 10^8$ | 27,800 | 2 calves (d21) 1 calf (d33) |
| TK #42 | $4.40 \times 10^8$ | 31,700 | 1 calf (d14) |
| TK #4 | $7.80 \times 10^8$ | 25,800 | 1 calf (d21) |
| TK #34 | $6.20 \times 10^8$ | 42,000 | 2 calves (d14); 1 calf (d33) |
| Control | 0 | <10,000 | None |

Figure 2:
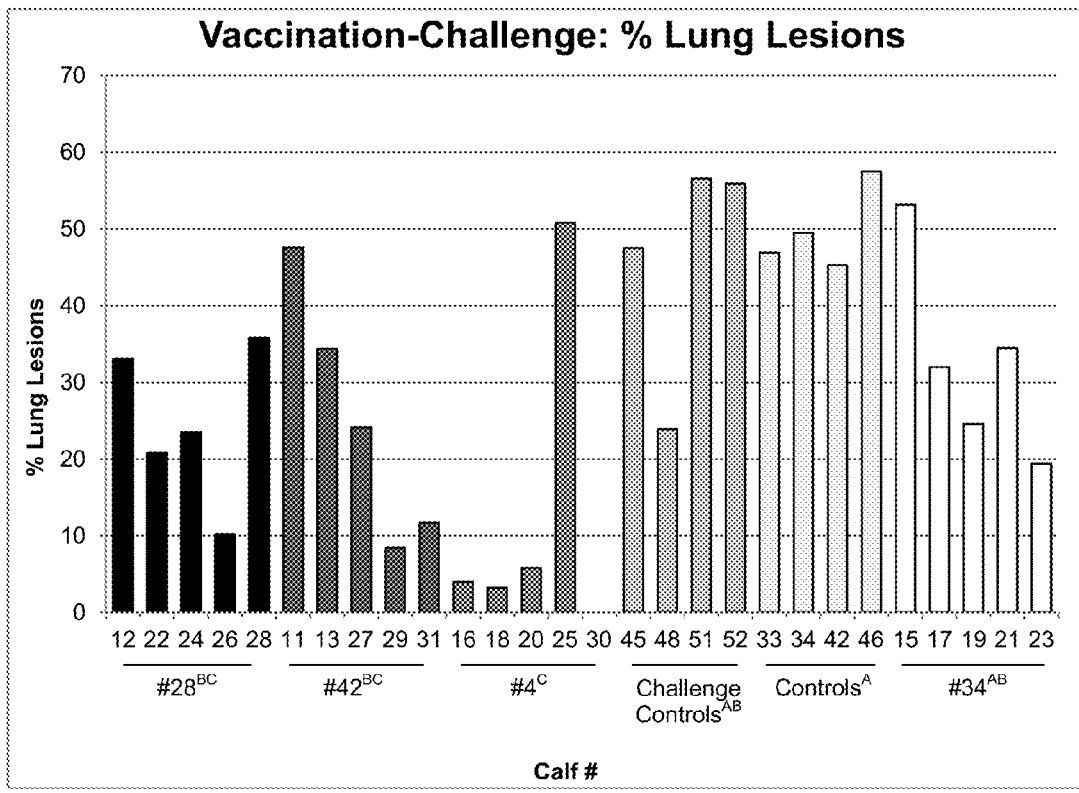
FIG. 2 shows the percent lung lesions observed for each calf in a vaccination-challenge study where the vaccine was administered intranasally. Bars of the same color represent the results for animals vaccinated with the same isolate. The vaccination isolate is listed below the bars, and all animals were challenged with the same challenge isolate. Groups followed by the same letter(s) are not significantly different according to Student's t performed on the arcsine transformed data.

The concentration of isolate TK #21 given to each calf at the time of challenge was $7.39 \times 10^9$ CFU/dose. The challenge was effective in determining the efficacy of the vaccines and to determine the most effective vaccine candidate. The clinical signs and percent of lung lesions show that isolate TK #4 was the most effective vaccine and isolate TK #34 was the least effective, while isolates TK #28 and TK #42 fall in between (Table 9; FIG. 2). *H. somni* was recovered from the lungs of all calves in the study, with the exception of 3 calves all of which were vaccinated with isolate TK #4, indicating that cause of death and/or disease for animals with lung lesions was attributable to the challenge isolate. During the study *P. multocida* was recovered from the nasal passages of some of the calves, increasingly as the study progressed. After challenge, *P. multocida* was recovered from the lung tissue of 9 of the 28 calves and *M. bovis* was detected in the lungs from three of the animals. Vaccination does not appear to correlate with the presence or absence of *P. multocida* or *M. bovis*. In addition, controls from the challenge model were not as susceptible to the challenge when compared to the control animals from this study. Since the challenge model controls were housed in the same barn as challenged animals, they may have acquired some immunity from previous exposure (Table 9).

TABLE 9

Clinical scores from animals vaccinated intranasally and challenged with *H. somni* wildtypes.

| Isolate | Average Clinical Score* |
|---|---|
| TK #28 | 5.80 BC |
| TK #42 | 6.00 BC |
| TK #4 | 1.40 C |
| TK #34 | 11.80 A |
| Controls | 10.50 AB |
| Controls from Challenge Model | 3.50 C |

*Is the average clinical scores from the last rating taken of the animals prior to death. Clinical scores with different letters are significantly different according to Student's t test.

Discussion.

As the data in the mouse model correlated well with the results obtained in calves, the inventors have provided a new and useful tool for selecting bovine vaccine/challenge candidates. Isolate TK #21 is an excellent challenge isolate due to its virulence and the reproducibility of the results. The ideal challenge dose appears to be around mid- to high-9 logs per dose in cattle when administered trans-tracheally.

When used as an intranasal vaccine, Isolate TK #4, was significantly protective against subsequent *H. somni* challenge (4 of 5 calves). Clinical signs and lung lesions were significantly different from non-vaccinates. Isolates TK #28 and TK #42 induced some protection in vaccinated calves, but the efficacy was lower (2 of 5 calves).

Example 3

Comparative Genomic Analysis of Virulent and Avirulent *H. somni* Isolates

As discussed above, various *H. somni* isolates had different levels of virulence in mice and cattle. One in particular, TK #4, showed promise as an intranasal cattle vaccine candidate (Example 2). In addition, TK #21 proved to be a highly virulent challenge isolate for cattle and mice, possessing a phenotype typical of challenge isolates used in the literature (2336 and HS91). To better understand the factors that affect this virulence and also to determine if recently acquired isolates remain similar to older isolates, eight *H. somni* isolates were submitted for whole genome sequencing. Four genes, a glycoside hydrolase family protein, a lipoprotein, a multicopper oxidase type 3, and a TetR family transcriptional regulator were found to be missing in TK #4, but present in TK #21. Also, the recently isolated *H. somni* lacked 211 to 316 genes present in 2336, a wildtype isolated in 1985. HS91, an isolate from 1991, lacked only 15 genes when compared to 2336. The data suggests that the genotype of TK #4 contributes to its avirulent phenotype, and that there is genetic drift within the *H. somni* population over time. The results demonstrate a genetic explanation for the attenuation of TK #4 and the need for current vaccine and challenge isolates to maintain efficacy in response to natural genetic drift.

To understand the genetic and molecular basis for the differential virulence a 9-way comparative genome analysis was carried out between TK #4, TK #21, TK #34, TK #28, TK #42, HS91, 2336 (a highly virulent strain, at least according to the literature), 129PT (a known avirulent strain in GenBank), and 153-3 (a moderately virulent strain), against GenBank isolate 2336. This analysis will also improve our understanding of possible genetic drift, and delineate genes involved in the virulence/avirulence mechanism.

Material and Methods

Sample Preparation for Sequencing

Eight *H. somni* isolates were identified as a diverse set of isolates that could be valuable in whole genome sequencing (Table 10). These isolates were from a number of locations, had a broad range of virulence, and were isolated from animals in different years. All these isolates were grown in Columbia broth (BD Ref#294420; Lot#0292713, Franklin Lakes, N.J.) and after growth, 10% glycerol was added to freeze the cultures in cryogenic vials (Fisher Scientific Cat.#10-500-26, Waltham, Mass.) at Newport Laboratories Research and Development facility (Worthington, Minn.) in a −80° C. freezer. The isolates were removed from the freezer and streak-plated onto Columbia Sheep Blood Agar plates (CSBA) (BD Ref#22165/221263; Lot#2227132 2012 11 13, Franklin Lakes, N.J.). The plates were incubated overnight at 37° C. with 5% $CO_2$. After 24-26 hours, the plates were removed from the incubator and used to lawn additional CSBA for growth overnight at 37° C. and 5% $CO_2$. After 16-18 hours of incubation the plates were washed with 2 mL pre-warmed Columbia broth with 100 μL or 150 μL used to start broth cultures of 25 mL Columbia broth for each of the cultures, using one flask for each inoculum amount. The broth cultures were shaken at 200 rpm and percent transmittance (% T)(540 nm) was monitored until the cultures reached 15-20% T. The broth cultures were removed from the incubator, pelleted three times in the same microcentrifuge tube by spinning 1.5 mL of culture each time for 2 min. at 15,000 rpm, and genomic DNA was isolated using a Bacterial Genomic DNA Purification Kit (Edge Biosystems, Gaithersburg, Md.), following the manufacturer's recommendation with slight modification. DNA was extracted in triplicate, from the triplicate spin pellets of each culture. A modification to the recommended DNA extraction process was the DNA was resuspended in 100 μL of TE and it was incubated for 15 min. at 37° C. to promote dissolving the DNA pellet without shearing the DNA. The three extractions were then pooled, compared on a 1% agarose gel, and quantified and purity checked on a Nanodrop. DNA amounts were calculated in order to provide the required total DNA for sequencing at the University of Idaho core facility (Moscow, Id.).

Then, all isolate reads were filtered for quality with the Illumina TruSeq adapters using SeqyClean, which is a read cleaning program developed at the University of Idaho (available on its website). This program removed the sequencing adapters and low quality reads which contained 5 or more bases with a Q-value <20, thus eliminating error during base reads and increasing accuracy.

Read Mapping

The genomic DNA results were mapped against 2336 in the NCBI database, Accession #CP000947 using bowtie2 default parameters. Filtering using a custom script for MAPQ <10 was used to remove multiply mapped reads. It is expected that identical isolates have an alignment rate >95%.

Gene Coverage

Samtools was used to calculate mapping coverage for each position against the 2336 reference. This was used to calculate the percentage of bases that had coverage for each gene. Genes that contained less than 80% of bases were called absent for that respective isolate. Two analyses were conducted on missing genes against 2336. The first compared HS91 (in a similar era as 2336), TK #21, TK #4, 153-3, and 129PT. The second compared TK #34, TK #42, 2336 (to confirm our 2336 matched the database), TK #28, and 129PT.

Pathogenicity Islands (PIs) and Integrative and Conjugative Elements (ICEs)

The results of the entire genome sequencing of HS91, TK #21, TK #4, 153-3 and 129PT were compared to 2336.

TABLE 10

List of *H. somni* isolates used for comparative genomic analysis.

| Isolate Name | Case # | Location | Phenotype |
|---|---|---|---|
| TK #34 | 11-3452-2 | Fairmont, MN | Reduced mortality in mice, but unable to reduce pneumonia as a cattle vaccine |
| HS91 | NA | Ames, IA | Wildtype from 1991 |
| TK #21 | 11-4134-1 | Marshall, MN | Highly virulent to mice and calves in challenge studies |
| TK #42 | 11-0141-1 | Parkston, SD | Had reduced virulence in mice and offered some protection as a mouse and cattle vaccine |
| 2336 | NA | Dr. Briggs | Industry standard for virulent *H. somni*; however, we found challenge inconsistency making us question age and number of passages |
| TK #28 | 11-0125-1 | Plainview, TX | Offered some protection to cattle |
| TK #4 | 12-0137-4 | Grandview, ID | Reduced virulence in mice, protected mice and cattle from challenge |
| 153-3 | NA | Worthington, MN | Wildtype recently obtained and seemed to be responsible for killing calves. In a calf challenge titration study it was not as virulent as TK #21. |

Filtering High Quality Reads and Sequence Coverage

To compare 129PT from the NCBI database, Accession #CP000436, against the 2336 Accession #CP000947, a similar approach to the field isolates needed to be used. Therefore, pseudo-reads were generated from 129PT with the ART read simulation software (hypertext transfer protocol://www.niehs.nih.gov/research/resources/software/biostatistics/art/). ART was run with the following command line: art_illumina −i Hs129PT.fasta −p −l250 −f 60 −m 500 −s 10 −na −o Hs129PT_sim, which equates to −p=paired, −l=25obp, −f=6ox coverage, −m=mean size of DNA fragments, −s=10 standard deviation of DNA fragment size.

Pathogenicity islands (PIs) and Integrative Conjugative Elements (ICEs) were searched for based on the presence of flanking signature sequences like recombinases, integrases, transposases, helicases, and phage repeats. Genomic regions containing a cluster of these putative signature sequences were identified as potential PIs or ICEs.

Results

The cleaned sequences had an approximate coverage of 100× for all isolates. The extent of the coverage gives us confidence in the quality of the called bases (Table 11).

TABLE 11

Quality of the raw reads and the estimated base coverage for each sequenced isolate.

| Library | PE Reads | Sequenced Bases | Estimated Raw Coverage | Cleaned PE Reads | Bases Kept After Cleaning | Estimated Cleaned Coverage |
|---|---|---|---|---|---|---|
| TK #34 | 454,197 | 235,274,046 | 103.93 | 460,095 | 210,850,732 | 93.14 |
| HS91 | 554,783 | 287,377,594 | 126.94 | 527,851 | 243,734,387 | 107.66 |
| TK #21 | 583,750 | 302,382,500 | 133.57 | 541,644 | 249,871,771 | 110.37 |
| TK #42 | 527,632 | 273,313,376 | 120.73 | 493,941 | 228,248,524 | 100.82 |
| 2336 | 848,512 | 439,529,216 | 194.15 | 809,986 | 378,965,750 | 167.40 |
| TK #28 | 544,568 | 282,086,244 | 124.60 | 520,290 | 241,511,214 | 106.68 |
| TK #4 | 606,064 | 313,941,152 | 138.68 | 570,358 | 261,675,306 | 115.59 |
| 153-3 | 463,065 | 239,867,670 | 105.96 | 441,209 | 202,578,292 | 89.48 |

The alignment revealed differences between the isolates and the reference strain. The GenBank 2336 isolate was 99.67% identical to the 2336 genome sequenced by Newport Labs, indicating the validity and accuracy of our map-based comparison between genomes. From there comparisons on similarities of the other isolates to 2336 were made with the second highest similarity to HS91. Also, the commensal 129PT (Accession #CP000436) in the NCBI database was aligned with the database's 2336 as a reference comparison (Table 12).

TABLE 12

The percentage of the sequencing data that aligned with the GenBank 2336 Accession # CP000947. Isolates are listed from highest to lowest percent alignment rate.

| Isolate | Alignment Rate (%) |
|---|---|
| HS91 | 99.71 |
| 2336 | 99.67 |
| 153-3 | 96.11 |
| TK #34 | 92.11 |
| TK #4 | 91.30 |
| TK #21 | 88.35 |
| 129PT* | 87.92 |
| TK #42 | 83.84 |
| TK #28 | 83.33 |

*Accession # CP000436.

Among the isolates, 129PT lacked many virulence and virulence-associated genes in comparison to the 2336 wildtype. The more recently acquired isolates lacked more total genes than the older isolates, when compared to the 2336 wildtype (Table 13).

TABLE 13

The number of genes estimated to be present or absent for each isolate sequenced in comparison to 2336 Accession # CP00947 in the NCBI database.

| Isolate | Genes Present | Genes Absent |
|---|---|---|
| 129PT* | 1593 | 472 |
| TK #34 | 1749 | 316 |
| TK #4 | 1758 | 307 |
| TK #21 | 1840 | 225 |
| TK #42 | 1848 | 217 |
| 153-3 | 1851 | 214 |
| TK #28 | 1854 | 211 |
| 2336 | 2048 | 17 |
| HS91 | 2050 | 15 |

*Accession # CP000436.

When comparing the genes that are absent in the first and second analyses relative to 2336, 129PT, the commensal, lacked more of those genes associated with pathogenicity and/or virulence than any other compared isolate. In total 129PT lacked 44 of the 47 total missing genes compiled from HS91, TK #21, TK #4, 153-3, and 129PT (Table 14). It also lacked 44 of the 47 total missing genes compiled from TK #34, TK #42, 2336, TK #28, and 129PT (Table 15). Isolate 2336 was found to lack only one identified pathogenicity-associated gene present in the NCBI database. This gene is a YadA domain-containing protein (Table 15).

The vaccine candidate, TK #4 lacked a total of 23 of the possible 47 absent genes from the isolates analyzed. This candidate lacked the attachment and adhesion genes of hemagglutinin/hemolysin, YadA domain-containing proteins (a total of 5 repeats missing), and a hemagglutinin domain-containing protein. TK#4 also lacked a transferrin binding protein (for iron uptake) and two isoforms of multicopper oxidase type 3 which provide the ability to uptake metals stored in the host. Genes responsible for host colonization such as glycoside hydrolase family protein (nasopharnyx colonization) and peptidase S8/S53 subtilisin kexin sedolisin were also missing from TK #4. Also, genes were missing that are responsible for drug resistance or response to stressors including two isoforms of a TetR family transcriptional regulator, acyltransferase 3, two isoforms of a MarR family transcriptional regulator, small multidrug resistance protein, the MarR family transcriptional regulator, and a stress-sensitive restriction system protein. Lastly, TK #4 lacked some genes that impact the pathogen's ability to evade host defenses such as lipooligosaccharide sialyltransferase, lipoprotein, and the Abi family protein (which is involved in self-immunity from bacteriocins) (Table 14).

In comparison to 2336, the highly pathogenic TK #21 also lacked similar virulence genes found to be missing in TK #4 (19 of the 23 missing TK #4 genes), with the exception of glycoside hydrolase family protein, lipoprotein, one isoform of multicopper oxidase type 3, and one isoform of the TetR family transcriptional regulator. The only gene that TK #21 lacked that TK #4 had was one repeat of the YadA domain-containing protein (Table 14).

HS91 was highly similar to 2336 and equally virulent according to published literature. None of the virulence or virulence-associated genes that could potentially play a role in pathogenesis was found to be missing in HS91 (Table 14).

Isolate 153-3 lacked many of the potential virulence genes found to be missing in TK#4 (14 of the 23 missing in TK #4), but there were some additional genes missing that were present in TK #4 (23 missing out of a total 47 identified across all isolates). In addition to TK #4, 153-3 lacked filamentous hemagglutinin outer membrane protein, adhesin, 10 repeats of the YadA domain-containing protein (compared to 5 with TK #4), glycosyl transferase family protein, and acetyltransferase. Genes that TK #4 lacked but were present in 153-3 were stress-sensitive restriction system protein, hemagglutinin domain-containing protein, glycoside hydrolase family protein, lipooligosaccharide sialyltransferase, Abi family protein, lipoprotein, one isoform of the multicopper oxidase type 3, one isoform of the TetR family transcriptional regulator, and peptidase S8/S53 subtilisin kexin sedolisin (Table 14).

The three recent isolates from the second analysis had more missing genes than older isolates. TK #34 lacked the most genes of the recent isolates, 22 out of 47. These genes included filamentous hemagglutinin outer membrane protein, hemagglutinin/hemolysin-like protein, adhesin, stress-sensitive restriction system, 6 repeats of the YadA domain-containing protein, transferrin binding protein, two isoforms of a hemagglutinin domain-containing protein, glycoside hydrolase family protein, TetR family transcriptional regulator, lob1 protein, two isoforms of the MerR family transcriptional regulator, multicopper oxidase type 3, small multidrug resistance protein, MarR family transcriptional regulator, and peptidase S8/S53 subtilisin kexin sedolisin. Of the 22 genes missing in TK #34, TK #42 was found to lack 12. These included: hemagglutinin/hemolysin-like protein, 5 repeats of the YadA domain-containing protein, one isoform of the TetR family transcriptional regulator, two isoforms of the MerR family transcriptional regulator, one isoform of multicopper oxidase type 3, small multidrug resistance protein, and MarR family transcriptional regulator. In addition to the 12 genes also absent with TK #34, TK #42 also lacked one repeat of the YadA domain-containing protein, glycosyl transferase family protein, virulence associated protein D (VapD), acyltransferase 3, lipoprotein, another isoform of multicopper oxidase type 3, and another isoform of the TetR transcriptional regulator. All the genes absent in TK #42 were also absent in TK #28, with no exceptions (Table 15).

TABLE 14

Genes involved in virulence that are missing in one or more of the analyzed genomes of HS91, TK #21, TK #4, 153-3, and 129PT, when compared to 2336 (Accession # CP00947).

| NCBI Gene # | Missing from? | Gene Name | Gene Function |
|---|---|---|---|
| HSM_0052 | 129PT | Outer membrane protein transport protein P1 | Can involve porins involved in transport of immunogenically important proteins and host evasion |
| HSM_0077 | 153-3 & 129PT | YadA domain-containing protein | Promotes pathogenicity and virulence in host cells through cell adhesion via a collagen binding outer-membrane protein |
| HSM_0164 | 129PT | Glycosyl transferase family protein | Involved in transferring a sugar moiety onto an acceptor, responsible for generating important virulence factors such as lipooligosaccharides (Kahler et. al. 1996) |
| HSM_0268 | 153-3 & 129PT | Filamentous hemagglutinin outer membrane protein | Mediates adherence to epithelial cells, macrophages and is required for tracheal colonization |
| HSM_0270 | TK #21, TK #4, 153-3, & 129PT | Hemagglutinin/hemolysin-like protein | Surface glycoprotein responsible for bacterial attachment to and penetration of host cells |
| HSM_0274 | 153-3 & 129PT | Adhesin | Involved in cell attachment |
| HSM_0338 | TK #21, TK #4, 153-3, & 129PT | YadA domain-containing protein | Promotes pathogenicity and virulence in host cells through cell adhesion via a collagen binding outer-membrane protein |
| HSM_0346 | 153-3 & 129PT | YadA domain-containing protein | Promotes pathogenicity and virulence in host cells through cell adhesion via a collagen binding outer-membrane protein |
| HSM_0377 | TK #21, TK #4, 153-3, & 129PT | YadA domain-containing protein | Promotes pathogenicity and virulence in host cells through cell adhesion via a collagen binding outer-membrane protein |
| HSM_0394 | 153-3 & 129PT | YadA domain-containing protein | Promotes pathogenicity and virulence in host cells through cell adhesion via a collagen binding outer-membrane protein |
| HSM_0598 | TK #21, TK #4, and 129PT | Stress-sensitive restriction system protein | Under stress it can allow bacteria to more easily pick up foreign DNA, such as phage DNA (Schäfer et. al. 1994) |
| HSM_0695 | 129PT | Alkaline phosphatase | Promotes biofilm formation |
| HSM_0708 | TK #21, TK #4, 153-3, & 129PT | YadA domain-containing protein | Promotes pathogenicity and virulence in host cells through cell adhesion via a collagen binding outer-membrane protein |
| HSM_0749 | TK #21, TK #4 & 153-3 | transferrin binding protein | Makes it possible for the bacteria to acquire stored iron from the host, which can affect virulence |
| HSM_0844 | 129PT | YadA domain-containing protein | Promotes pathogenicity and virulence in host cells through cell adhesion via a collagen binding outer-membrane protein |
| HSM_0953 | TK #21 & TK #4 | Hemagglutinin domain-containing protein | Involved in bacterial adhesion |
| HSM_0975 | 129PT | Glycosyl transferase family protein | Involved in transferring a sugar moiety onto an acceptor, responsible for generating important virulence factors such as lipooligosaccharides (Kahler et. al. 1996) |
| HSM_0977 | 153-3 & 129PT | Glycosyl transferase family protein | Involved in transferring a sugar moiety onto an acceptor, responsible for generating important |

TABLE 14-continued

Genes involved in virulence that are missing in one or more of the analyzed genomes
of HS91, TK #21, TK #4, 153-3, and 129PT, when compared to 2336 (Accession # CP00947).

| NCBI Gene # | Missing from? | Gene Name | Gene Function |
|---|---|---|---|
| | | | virulence factors such as lipooligosaccharides (Kahler et. al. 1996) |
| HSM_0978 | 129PT | Glycosyl transferase family protein | Involved in transferring a sugar moiety onto an acceptor, responsible for generating important virulence factors such as lipooligosaccharides (Kahler et. al. 1996) |
| HSM_1089 | 129PT | Hemolysin activation/secretion protein-like protein | Involved in the lysis of red blood cells |
| HSM_1090 | 129PT | Filamentous hemagglutinin outer membrane protein | Can be involved in the secretion of adhesins that facilitate adhesion to the host or other cells, necessary for host colonization |
| HSM_1160 | TK #4 & 129PT | Glycoside hydrolase family protein | Can play a role in peptidoglycan degradation and also in colonization of the nasopharnyx and invasion of host epithelial cells |
| HSM_1191 | TK #21, TK #4, 153-3, & 129PT | TetR family transcriptional regulator | Involved in the transcriptional control of multidrug efflux pumps, pathways for the biosynthesis of antibiotics, response to osmotic stress and toxic chemicals, control of catabolic pathways, differentiation processes, and pathogenicity (Ramos et. al. 2005) |
| HSM_1212 | 129PT | hemagglutinin domain-containing protein | Involved in bacterial adhesion |
| HSM_1257 | TK #21, TK #4, 153-3, & 129PT | YadA domain-containing protein | Promotes pathogenicity and virulence in host cells through cell adhesion via a collagen binding outer-membrane protein |
| HSM_1426 | TK #21, TK #4, & 129PT | Lipooligosaccharide sialyltransferase | Affects the ornamentation on the lipooligosaccharide and impacts the pathogen's ability to evade host defenses |
| HSM_1448 | 129PT | Virulence-associated protein D (VapD) region | Toxin/antitoxin locus, can be involved in translation during stressful conditions, translation arrest would improve survival in the host and promote chronic mucosal infections (Daines et. al. 2004) |
| HSM_1484 | 153-3 & 129PT | YadA domain-containing protein | Promotes pathogenicity and virulence in host cells through cell adhesion via a collagen binding outer-membrane protein |
| HSM_1542 | 153-3 & 129PT | YadA domain-containing protein | Promotes pathogenicity and virulence in host cells through cell adhesion via a collagen binding outer-membrane protein |
| HSM_1571 | TK #21 & 129PT | YadA domain-containing protein | Promotes pathogenicity and virulence in host cells through cell adhesion via a collagen binding outer-membrane protein |
| HSM_1616 | TK #21, TK #4, & 129PT | Abi family protein | Involved in self-immunity to bacteriocins (Kjos et. al. 2010) |
| HSM_1624 | TK #21, TK #4, 153-3 & 129PT | Acyltransferase 3 | Drug resistance and other host evasion responses can be dependent on the presence of acyltransferases |
| HSM_1647 | 129PT | FhaB protein | Can have a role in host-cell binding and infection |
| HSM_1651 | 129PT | Filamentous hemagglutinin outer membrane protein | Can be involved in the secretion of adhesins that facilitate adhesion to the host or other cells, necessary for host colonization |
| HSM_1667 | 129PT | Lob1 protein | Involved in lipooligosaccharide biosynthesis for evading or delaying host recognition (Cox et. al. 1998) |
| HSM_1669 | 153-3 | Acetyltransferase | Involved in evading the host immune system, virulence, and drug resistance (Aubry et. al. 2011) |
| HSM_1714 | TK #4 & 129PT | Lipoprotein | Expressed on the cell surface and can be involved in host evasion and virulence |
| HSM_1726 | TK #4 & 129PT | Multicopper oxidase type 3 | Could be involved in Iron (II) acquisition in low oxygen environments from inflamed tissue, such as lung colonization of the host (Huston et. al. 2002) |
| HSM_1728 | TK #21, TK #4, 153-3, 129PT | MerR family transcriptional regulator | Transcriptional regulator via a suboptimal promoter that responds to stressors such as oxidative stress, heavy metals, or antibiotics (Brown et. al. 2003) |
| HSM_1730 | TK #21, TK #4, 153-3, 129PT | Multicopper oxidase type 3 | Could be involved in Iron (II) acquisition in low oxygen environments from inflamed tissue, such as lung colonization of the host (Huston et. al. 2002) |
| HSM_1734 | TK #4, 129PT | TetR family transcriptional regulator | Involved in the transcriptional control of multidrug efflux pumps, pathways for the biosynthesis of antibiotics, response to osmotic stress and toxic chemicals, control of catabolic pathways, |

TABLE 14-continued

Genes involved in virulence that are missing in one or more of the analyzed genomes of HS91, TK #21, TK #4, 153-3, and 129PT, when compared to 2336 (Accession # CP00947).

| NCBI Gene # | Missing from? | Gene Name | Gene Function |
|---|---|---|---|
| | | | differentiation processes, and pathogenicity (Ramos et. al. 2005) |
| HSM_1736 | TK #21, TK #4, 153-3 & 129PT | Small multidrug resistance protein | Drug efflux protein involved in antibiotic resistance (Alekshun and Levy, 2007). |
| HSM_1737 | TK #21, TK #4, 153-3 & 129PT | MarR family transcriptional regulator | Regulate activity of genes involved in antibiotic resistance, stress responses, virulence or catabolism of aromatic compounds (Perera and Grove, 2010) |
| HSM_1741 | TK #21, TK #4, 153-3 & 129PT | MerR family transcriptional regulator | Transcriptional regulator via a suboptimal promoter that responds to stressors such as oxidative stress, heavy metals, or antibiotics (Brown et. al. 2003) |
| HSM_1793 | TK #21, TK #4, 153-3 & 129PT | YadA domain containing protein | Promotes pathogenicity and virulence in host cells through cell adhesion via a collagen binding outer-membrane protein |
| HSM_1794 | 129PT | Glycosyl transferase family protein | Involved in transferring a sugar moiety onto an acceptor, responsible for generating important virulence factors such as lipooligosaccharides (Kahler et. al. 1996) |
| HSM_1889 | TK #21, TK #4, & 129PT | Peptidase S8/S53 subtilisin kexin sedolisin | Functions as a hydrolase, protease, and serine protease that help with initial colonization of the host |

TABLE 15

Genes involved in virulence that are missing in one or more of the analyzed genomes of TK #34, TK #42, 2336, TK #28, and 129PT, when compared to 2336 (Accession # CP00947 in the NCBI database).

| 2336 NCBI Gene # | Missing from? | Gene Name | Gene Function |
|---|---|---|---|
| HSM_0052 | 129PT | Outer membrane protein transport protein P1 | Can involve porins involved in transport of immunogenically important proteins and host evasion |
| HSM_0077 | TK #42, TK #28, & 129PT | YadA domain-containing protein | Promotes pathogenicity and virulence in host cells through cell adhesion via a collagen binding outer-membrane protein |
| HSM_0164 | 129PT | Glycosyl transferase family protein | Involved in transferring a sugar moiety onto an acceptor, responsible for generating important virulence factors such as lipooligosaccharides (Kahler et. al. 1996) |
| HSM_0268 | TK #34 & 129PT | Filamentous hemagglutinin outer membrane protein | Mediates adherence to epithelial cells, macrophages and is required for tracheal colonization |
| HSM_0270 | TK #34, TK #42, TK #28, & 129PT | Hemagglutinin/hemolysin-like protein | Surface glycoprotein responsible for bacterial attachment to, and penetration of, host cells |
| HSM_0274 | TK #34 & 129PT | Adhesin | Involved in cell attachment |
| HSM_0338 | 129PT | YadA domain-containing protein | Promotes pathogenicity and virulence in host cells through cell adhesion via a collagen binding outer-membrane protein |
| HSM_0346 | 129PT | YadA domain-containing protein | Promotes pathogenicity and virulence in host cells through cell adhesion via a collagen binding outer-membrane protein |
| HSM_0377 | 129PT | YadA domain-containing protein | Promotes pathogenicity and virulence in host cells through cell adhesion via a collagen binding outer-membrane protein |
| HSM_0394 | 129PT | YadA domain-containing protein | Promotes pathogenicity and virulence in host cells through cell adhesion via a collagen binding outer-membrane protein |
| HSM_0598 | TK #34 & 129PT | Stress-sensitive restriction system protein | Under stress it can allow bacteria to more easily pick up foreign DNA, such as phage DNA (Schäfer et. al. 1994) |
| HSM_0695 | 129PT | Alkaline phosphatase | Promotes biofilm formation |
| HSM_0708 | TK #34, TK #42, TK #28, & 129PT | YadA domain-containing protein | Promotes pathogenicity and virulence in host cells through cell adhesion via a collagen binding outer-membrane protein |

TABLE 15-continued

Genes involved in virulence that are missing in one or more of the analyzed genomes of TK #34, TK #42, 2336, TK #28, and 129PT, when compared to 2336 (Accession # CP00947 in the NCBI database).

| 2336 NCBI Gene # | Missing from? | Gene Name | Gene Function |
|---|---|---|---|
| HSM_0749 | TK #34 | Transferrin binding protein | Makes it possible for the bacteria to acquire stored iron from the host, which can affect virulence |
| HSM_0844 | 129PT | YadA domain-containing protein | Promotes pathogenicity and virulence in host cells through cell adhesion via a collagen binding outer-membrane protein |
| HSM_0938 | TK #34 | Hemagglutinin domain-containing protein | Involved in bacterial adhesion |
| HSM_0975 | TK #42, TK #28, & 129PT | Glycosyl transferase family protein | Involved in transferring a sugar moiety onto an acceptor, responsible for generating important virulence factors such as lipooligosaccharides (Kahler et. al. 1996) |
| HSM_0977 | 129PT | Glycosyl transferase family protein | Involved in transferring a sugar moiety onto an acceptor, responsible for generating important virulence factors such as lipooligosaccharides (Kahler et. al. 1996) |
| HSM_0978 | 129PT | Glycosyl transferase family protein | Involved in transferring a sugar moiety onto an acceptor, responsible for generating important virulence factors such as lipooligosaccharides (Kahler et. al. 1996) |
| HSM_1022 | TK #34 | YadA domain-containing protein | Promotes pathogenicity and virulence in host cells through cell adhesion via a collagen binding outer-membrane protein |
| HSM_1089 | 129PT | Hemolysin activation/secretion protein-like protein | Involved in the lysis of red blood cells |
| HSM_1090 | 129PT | Filamentous hemagglutinin outer membrane protein | Mediates adherence to epithelial cells, macrophages and is required for tracheal colonization |
| HSM_1160 | TK #34 & 129PT | Glycoside hydrolase family protein | Can play a role in peptidoglycan degradation and also in colonization of the nasopharnyx and invasion of host epithelial cells |
| HSM_1191 | TK #34, TK #42, TK #28, & 129PT | TetR family transcriptional regulator | Involved in the transcriptional control of multidrug efflux pumps, pathways for the biosynthesis of antibiotics, response to osmotic stress and toxic chemicals, control of catabolic pathways, differentiation processes, and pathogenicity (Ramos et. al. 2005) |
| HSM_1212 | TK #34 & 129PT | Hemagglutinin domain-containing protein | Involved in bacterial adhesion |
| HSM_1257 | TK #34, TK #42, TK #28, & 129PT | YadA domain-containing protein | Promotes pathogenicity and virulence in host cells through cell adhesion via a collagen binding outer-membrane protein |
| HSM_1426 | 129PT | Lipooligosaccharide sialyltransferase | Affects the ornamentation on the lipooligosaccharide and impacts the pathogen's ability to evade host defenses |
| HSM_1448 | TK #42, TK #28, & 129PT | Virulence-associated protein D (VapD) region | Toxin/antitoxin locus, can be involved in translation during stressful conditions, translation arrest would improve survival in the host and promote chronic mucosal infections (Daines et. al. 2004) |
| HSM_1484 | 129PT | YadA domain-containing protein | Promotes pathogenicity and virulence in host cells through cell adhesion via a collagen binding outer-membrane protein |
| HSM_1542 | TK #34, TK #42, TK #28, & 129PT | YadA domain-containing protein | Promotes pathogenicity and virulence in host cells through cell adhesion via a collagen binding outer-membrane protein |
| HSM_1571 | TK #34, TK #42, TK #28, & 129PT | YadA domain-containing protein | Promotes pathogenicity and virulence in host cells through cell adhesion via a collagen binding outer-membrane protein |
| HSM_1616 | 129PT | Abi family protein | Involved in self-immunity to bacteriocins (Kjos et. al. 2010) |
| HSM_1624 | TK #42, TK #28, & 129PT | Acyltransferase 3 | Drug resistance and other host evasion responses can be dependent on the presence of acyltransferases |
| HSM_1647 | 129PT | FhaB protein | Can have a role in host-cell binding and infection |
| HSM_1651 | 129PT | Filamentous hemagglutinin | Can be involved in the secretion of adhesins that facilitate adhesion to the host or other |

TABLE 15-continued

Genes involved in virulence that are missing in one or more of the analyzed genomes of TK #34, TK #42, 2336, TK #28, and 129PT, when compared to 2336 (Accession # CP00947 in the NCBI database).

| 2336 NCBI Gene # | Missing from? | Gene Name | Gene Function |
|---|---|---|---|
| | | outer membrane protein | cells, necessary for host colonization |
| HSM_1667 | TK #34 & 129PT | Lob1 protein | Involved in lipooligosaccharide biosynthesis for evading or delaying host recognition (Cox et. al. 1998) |
| HSM_1714 | TK #42, TK #28, & 129PT | Lipoprotein | Expressed on the cell surface and can be involved in host evasion and virulence |
| HSM_1726 | TK #42, TK #28, & 129PT | Multicopper oxidase type 3 | Could be involved in Iron (II) acquisition in low oxygen environments from inflamed tissue, such as lung colonization of the host (Huston et. al. 2002) |
| HSM_1728 | TK #34, TK #42, TK #28, & 129PT | MerR family transcriptional regulator | Transcriptional regulator via a suboptimal promoter that responds to stressors such as oxidative stress, heavy metals, or antibiotics (Brown et. al. 2003) |
| HSM_1730 | TK #34, TK #42, TK #28, & 129PT | Multicopper oxidase type 3 | Could be involved in Iron (II) acquisition in low oxygen environments from inflamed tissue, such as lung colonization of the host (Huston et. al. 2002) |
| HSM_1734 | TK #42, TK #28, & 129PT | TetR family transcriptional regulator | Involved in the transcriptional control of multidrug efflux pumps, pathways for the biosynthesis of antibiotics, response to osmotic stress and toxic chemicals, control of catabolic pathways, differentiation processes, and pathogenicity (Ramos et. al. 2005) |
| HSM_1736 | TK #34, TK #42, TK #28, & 129PT | Small multidrug resistance protein | Drug efflux protein involved in antibiotic resistance (Alekshun and Levy, 2007) |
| HSM_1737 | TK #34, TK #42, TK #28, & 129PT | MarR family transcriptional regulator | Regulate activity of genes involved in antibiotic resistance, stress responses, virulence or catabolism of aromatic compounds (Perera and Grove, 2010) |
| HSM_1741 | TK #34, TK #42, TK #28, & 129PT | MerR family transcriptional regulator | Transcriptional regulator via a suboptimal promoter that responds to stressors such as oxidative stress, heavy metals, or antibiotics (Brown et. al. 2003) |
| HSM_1793 | TK #34, TK #42, 2336, TK #28, &129PT | YadA domain-containing protein | Promotes pathogenicity and virulence in host cells through cell adhesion via a collagen binding outer-membrane protein |
| HSM_1794 | 129PT | Glycosyl transferase family protein | Involved in transferring a sugar moiety onto an acceptor, responsible for generating important virulence factors such as lipooligosaccharides (Kahler et. al. 1996) |
| HSM_1889 | TK #34 & 129PT | Peptidase S8/S53 subtilisin kexin sedolisin | Functions as a hydrolase, protease, and serine protease that helps with initial colonization of the host |

Seven Putative PIs or ICEs were Identified from the Whole Genome Compilation.

The first one is located between HSM_R0009 to approximately HSM_0254 (~28 kb), but no notable virulence, virulence-associated, or drug resistance genes appear to be present in this location. HS91 and 2336 contained all of the genes present; however, TK #21, TK #4, 153-3, 129PT, and TK #34 appear to lack the majority of the genes located in this PI or ICE. TK #42 and TK #28 have part of this first PI or ICE.

The second location was between HSM_0319 to HSM_0348 (~41 kb), and at this location there were two repeats of YadA domain-containing proteins, one which was lacking in TK #21, TK #4, 153-3, and 129PT and the other was missing in 153-3 and 129PT.

A third PI was located between HSM_0638 to HSM_0692 (~45 kb). Isolates 153-3, 129PT, and TK #34 lacked many of the genes in this potential PI or ICE; however, none were identified as putative virulence, virulence-associated, or drug resistance genes, because many of the genes in the PI were only identified as hypothetical proteins.

The fourth PI location was between HSM_0847 and HSM_0923 (~73 kb). Again no virulence factors were identified within this range; however TK #21, TK #4, 153-3, 129PT, and TK #34 lacked a majority of the genes found in this region.

The fifth PI location was between HSM_1115 and HSM_1167 (~51 kb). TK #4 lacks HSM_1129 to HSM_1146 and HSM_1149 to HSM_1167, this absent region includes a glycoside hydrolase family protein. Isolate 129PT lacks HSM_1131 to HSM_1167, and TK #34 lacks HSM_1129 to HSM_1144 and HSM_1149 to HSM_1167, but the other isolates have most of these genes present. There is also a two-component response regulator at HSM_1124 that can be involved in helping the bacteria sense and respond to a wide variety of environments. All of the sequenced isolates contain this two-component response regulator.

The sixth putative PI or ICE is from HSM_1615 to HSM_1719 (~101 kb). In this region, there is an Abi family protein, acyltransferase 3, FhaB protein, filamentous hemagglutinin outer membrane protein, Lob1 protein, acetyltransferase, and a lipoprotein. TK #21, TK #4, 153-3, 129PT, TK #28, TK #42, and TK #34 lack some of these (Tables 14 & 15), potentially contributing to their different levels of virulence.

The last potential PI or ICE is located at HSM_1860 to HSM_R0065 (~38 kb). One key gene that is missing from TK #21, TK #4, 129PT, and TK #34 in this region is the peptidase S8/S53 subtilisin kexin sedolisin, which is important for initial host colonization. There are other genes missing from TK #21, TK #4, 129PT, TK #34, TK #42, and TK #28, most of which are identified as hypothetical proteins or transposases. HS91, 153-3, TK #42, 2336, and TK #28 appear to have most or all this entire region intact.

Discussion

TK #4 appears to be sufficiently attenuated, while still capable of eliciting an adequate immune response, making the strain a strong vaccine candidate. TK #4 lacks some genes similar to other isolates acquired about the same year; however, some of the absent genes are unique to TK #4, including: a glycoside hydrolase family protein (GHFP), a lipoprotein (LP), a multicopper oxidase type 3, and a TetR family transcriptional regulator. Several genes, missing from both TK #4 and pathogenic isolates, may contribute to the attenuated phenotype, however, these genes do not appear to be necessary for avirulence.

On the other hand, two genes uniquely absent from TK #4, while present in pathogenic strains, glycoside hydrolase family protein and lipoprotein, appear to be necessary and sufficient for TK #4's attenuated phenotype.

A causal link between the absence of expression of these two genes—in TK #4—and the attenuated virulence is supported by previously published work, which indicates the GHFP and LP proteins play an important role in colonization and evasion of host defenses (Asgarali et. al. 2009; Garbe and Collin, 2010; Liu et. al. 2008; and Guzmán-Brambila et. al. 2012). Moreover, the data indicate that while TK #4 is not as attenuated as 129PT, the strain affords protection (from subsequent virulent challenge) to both cattle and mice.

TK #34 is also highly attenuated similar to TK #4; however, TK #4 is missing a greater number of genes involved in host evasion. TK #4 and TK #34 both lack various isoforms or repeats of hemagglutinin domain-containing proteins and YadA domain-containing proteins, respectively. TK #34 lacks a filamentous hemagglutinin outer membrane protein, adhesion, and the lob1 protein, which TK #4 has. TK #4 lacks a lipooligosaccharide sialyltransferase, Abi family protein, acyltransferase 3, lipoprotein, multicopper 3, and TetR transcriptional regulator that are present in TK #34. The results indicate that the combination of missing virulence factors contributes to a partially attenuated bacteria that is protective in mice and cattle (TK #4) or to a highly attenuated but not protective isolate for mice and cattle (TK #34). The data here alone indicate that a skilled person could not have predicted ahead of time which genes should be deleted to obtain a sufficiently attenuated, yet sufficiently protective, *H. somni* vaccine strain.

Finally, horizontal gene transfer appears not to have passed some resistance genes to this isolate, and a lack of other virulence factors appear to have attenuated the isolate sufficiently to render it incapable of causing disease. On the other hand, the presence of more virulence factors than a commensal strain makes TK #4 a strong vaccine candidate (i.e. the strain can survive long enough to stimulate the host humoral immune response and provide longer-term protection).

TK #21 was found to be a highly virulent isolate in mice and cattle. However, genetically, it was more similar to current isolates, TK #4 and 153-3 (less virulence relative to TK #21), while at the same time more divergent from other known virulent strains, 2336 and HS91. TK #21 did possess a, glycoside hydrolase family protein, a lipoprotein, one isoform of multicopper oxidase type 3, and one isoform of the TetR family transcriptional regulator that TK #4 lacked. These 4 genes may all contribute to the attenuation of TK #4. The most unique genes missing that were not found missing as different isoforms in TK #21, were glycoside hydrolase and a lipoprotein. These genes in combination appear to be necessary for causing the sufficient difference between a challenge isolate (has the genes) and a vaccine candidate (lacks the genes). TK #21 did lack a Yad A domain-containing protein that TK #4 had; however, it does not seem to contribute to lack of virulence. It seems that virulence associated with TK #21 is not due to its divergence from 2336, but instead to its subtle differences from TK #4.

The more recent isolates of TK #21, TK #4, 153-3, TK #34, TK #42, and TK #28 appear to be similar, but they are notably different from 2336 and HS91 (see Table 15). The data suggests that the *H. somni* population is evolving over time and that the generally accepted challenge isolate of 2336 may no longer be relevant to the *H. somni* gene pool calves are currently facing. This also provides evidence to support TK #4 as a vaccine candidate, since its genetic composition is highly relevant to currently circulated strains in the calf bovine respiratory disease complex. The alignment rate supports that HS91 and 2336 are very closely related, and that TK #21, TK #4, 153-3, TK #34, TK #42, and TK #28 are closely related. It also shows that the current isolates are genetically different from those isolated in the 1980-1990s. Also, when looking at gene absence, the more current isolates lack higher numbers of 2336 genes than HS91, and the current isolates also tend to lack similar genes. This implies that genomes are naturally drifting in *H. somni*. Also, since the current isolates represent different states within the U.S., it implies that the genetic drift seen here is representative of the current *H. somni* population in the U.S.

Overall, this data indicates that a combination of a number of genes may be required to make an isolate an effective vaccine or challenge candidate, and the loss of only a few genes can attenuate the candidate enough to save an animal versus take its life. This data also suggests, that the *H. somni* population does drift over time and that the industry needs to evolve in order to maintain relevant vaccines. The data strongly supports the importance of autogenous vaccines, as well as, periodic re-evaluation of commercial vaccine efficacy.

TABLE 16

The variants identified (with respect to 2336, accession #CP00947) for each isolate analyzed with "SAMTools mpileup."

| Sample | Total Variants | Filtered variants |
|---|---|---|
| 129PT | 22,040 | 21,733 |
| TK #34 | 23,386 | 23,179 |
| HS91 | 132 | 12 |
| HS91 ΔaroC | 1,481 | 1,343 |
| TK #21 | 25,840 | 25,157 |
| TK #42 | 21,833 | 21,677 |
| 2336 (Applicants' isolate) | 134 | 15 |
| TK #28 | 21,803 | 21,590 |
| TK #4 | 25,868 | 25,176 |

TABLE 16-continued

The variants identified (with respect to 2336, accession #CP00947) for each isolate analyzed with "SAMTools mpileup."

| Sample | Total Variants | Filtered variants |
|---|---|---|
| 153-3 | 21,260 | 20,750 |
| HS91 ΔnanPU | 1,468 | 1,330 |

In addition to many SNPs identified (Table 16), there were also numerous missing genes (Tables 17-23). The more recent isolates (TK #21, TK #4, 153-3, TK #34, TK #42, and TK #28) and 129PT had the most SNPs, while the HS91 wildtype, HS91 mutants, and 2336 had few to no SNPs for all virulence-associated genes. For the LOS biosynthesis or modification genes, the highest percentage SNPs were found in the glycosyl transferase and acetyltransferase genes in both analyses, and in lob2b of the group 2 analysis. Isolate 129PT lacked the most LOS biosynthesis or modification genes. For the adhesion, colonization, and biofilm formation genes, the most SNPs occurred in the YadA domain-containing proteins and the hemagglutinin domain-containing proteins. Many of the adhesion, colonization, and biofilm formation genes were missing in the recent isolates. Glycoside hydrolase in group 1 and in both groups some of the TonB-dependent receptors had the most SNPs for host invasion or metal uptake. Many of the stress-response, antibiotic resistance genes, and drug efflux genes were missing from most of the newer isolates. Of those that were present, the percentage of SNPs was fairly low with the exception of the TetR family transcriptional regulator in group 1.

For genes involved in LOS biosynthesis or modification, all isolates with the exception of 129PT had 1 indel in OMP transport protein P1. TK #21 and TK #34 had 1 and 2 indels, respectively, for lob2b. All recent isolates had 1 indel for pgmB, but the older isolates of HS91 and 2336 did not. TK #42 and TK #28 had 1 indel in a glycosyl transferase family protein, and they had 1 indel in lob2a. Isolate 129PT had an indel in neuA$_{HS}$.

In the group 1 analysis of non-synonymous indels for virulence-associated genes involved in adhesion, colonization, and biofilm formation, TK #21 and TK #4 had the most indels. These occurred in the YadA domain-containing proteins (26 total indels for TK #21 and 32 total indels for TK #4), filamentous hemagglutinin outer membrane proteins (6 total indels for TK #21 and 5 total indels for TK #4), and 1 indel for TK #21 in an adhesin. Isolate 153-3 also had some indels in group 1 but lacked the majority of the genes analyzed, somewhat similar to 129PT. Of those genes present with non-synonymous indels were YadA domain containing proteins (total of 6 indels), a filamentous hemagglutinin outer membrane protein (3 indels), and a hemagglutinin domain-containing protein (1 indel; Table 19). For the analysis on group 2 of the adhesion, colonization, and biofilm formation, isolates TK #34, TK #42, and TK #28 had the most indels. The indels were present in YadA domain-containing proteins (24 total indels for TK #34, 31 total indels for TK #42, and 31 total indels for TK #28), filamentous hemagglutinin outer membrane proteins (2 total indels for TK #34, 4 total indels for TK #42, and 4 total indels for TK #28) and 1 indel for a hemagglutinin domain-containing protein for TK #34. Also, 129PT had 7 indels for the YadA domain-containing proteins and 1 indel in a hemagglutinin domain-containing protein, although it lacked many of the genes analyzed. Lastly, HS91 ΔaroC and HS91 ΔnanPU had 3 and 2 total indels, respectively, for a filamentous hemagglutinin outer membrane protein and 1 each for a YadA domain-containing protein (Table 20).

TABLE 17

Number of indels present in isolates from group 1 analysis of virulence-associated genes involved in lipooligosaccharide (LOS) biosynthesis or modification.

| | | # of Non-synonymous Indels Present | | | | |
|---|---|---|---|---|---|---|
| Gene Number | Total bp | HS91 | TK #21 | TK #4 | 153-3 | 129PT |
| HSM_0052 | 234 | 1 | 1 | 1 | 1 | * |
| HSM_0164 | 1569 | 0 | 0 | 0 | 0 | * |
| HSM_0204 | 1383 | 0 | 0 | 0 | 0 | 0 |
| HSM_0397 | 930 | 0 | 0 | 0 | 0 | 0 |
| HSM_0572 | 555 | 0 | 0 | 0 | 0 | 0 |
| HSM_0840 | 588 | 0 | 0 | 0 | 0 | 0 |
| HSM_0925 | 1431 | 0 | 0 | 0 | 0 | 0 |
| HSM_0938 | 1167 | 0 | 0 | 0 | 0 | 0 |
| HSM_0975 | 696 | 0 | 0 | 0 | 0 | * |
| HSM_0977 | 834 | 0 | 1 | 0 | * | * |
| HSM_0978 | 816 | 0 | 0 | 0 | 0 | * |
| HSM_1062 | 1365 | 0 | 0 | 0 | 0 | 0 |
| HSM_1063 | 888 | 0 | 0 | 0 | 0 | 0 |
| HSM_1117 | 672 | 0 | 0 | 0 | 0 | 1 |
| HSM_1118 | 1020 | 0 | 0 | 0 | 0 | 0 |
| HSM_1256 | 1017 | 0 | 0 | 0 | 0 | 0 |
| HSM_1426 | 903 | 0 | * | * | 0 | * |
| HSM_1667 | 129 | 0 | 0 | 0 | 0 | * |
| HSM_1669 | 876 | 0 | 0 | 0 | * | 0 |
| HSM_1714 | 630 | 0 | 0 | * | 0 | * |
| HSM_1794 | 936 | 0 | 0 | 0 | 0 | * |
| HSM_1832 | 1656 | 0 | 1 | 1 | 1 | 1 |

* Indicates when a gene was found to be missing for that particular isolate.

TABLE 18

Number of indels present in isolates from group 2 analysis of virulence-associated genes involved in lipooligosaccharide (LOS) biosynthesis or modification.

| | | # of Non-synonymous Indels Present | | | | | |
|---|---|---|---|---|---|---|---|
| Gene Number | Total bp | TK | HS91 | TK | 2336 | TK | HS91 | 129PT |
| HSM_0052 | 234 | 1 | 1 | 1 | 1 | 1 | 1 | * |
| HSM_0164 | 1569 | 0 | 0 | 1 | 0 | 1 | 0 | * |
| HSM_0204 | 1383 | 0 | 0 | 0 | 0 | 0 | 0 | 0 |
| HSM_0397 | 930 | 0 | 0 | 0 | 0 | 0 | 0 | 0 |
| HSM_0572 | 555 | 0 | 0 | 0 | 0 | 0 | 0 | 0 |
| HSM_0840 | 588 | 0 | 0 | 0 | 0 | 0 | 0 | 0 |
| HSM_0925 | 1431 | 0 | 0 | 0 | 0 | 0 | 0 | 0 |
| HSM_0938 | 1167 | * | 0 | 0 | 0 | 0 | 0 | 0 |
| HSM_0975 | 696 | 0 | 0 | * | 0 | * | 0 | * |
| HSM_0977 | 834 | 2 | 0 | 0 | 0 | 0 | 0 | * |
| HSM_0978 | 816 | 0 | 0 | 1 | 0 | 1 | 0 | * |
| HSM_1062 | 1365 | 0 | 0 | 0 | 0 | 0 | 0 | 0 |
| HSM_1063 | 888 | 0 | 0 | 0 | 0 | 0 | 0 | 0 |
| HSM_1117 | 672 | 0 | 0 | 0 | 0 | 0 | 0 | 1 |
| HSM_1118 | 1020 | 0 | 0 | 0 | 0 | 0 | 0 | 0 |
| HSM_1256 | 1017 | 0 | 0 | 0 | 0 | 0 | 0 | 0 |
| HSM_1426 | 903 | 0 | 0 | 0 | 0 | 0 | 0 | * |
| HSM_1667 | 129 | * | 0 | 0 | 0 | 0 | 0 | * |
| HSM_1669 | 876 | 0 | 0 | 0 | 0 | 0 | 0 | 0 |
| HSM_1714 | 630 | 0 | * | * | 0 | * | * | * |
| HSM_1794 | 936 | 0 | 0 | 0 | 0 | 0 | 0 | * |
| HSM_1832 | 1656 | 1 | 0 | 1 | 0 | 1 | 0 | 1 |

* Indicates when a gene was found to be missing for that particular isolate.

TABLE 19 (5)

Number of indels present in isolates from group 1 analysis of virulence-associated genes involved in adhesion, colonization, or biofilm formation.

| Gene Number | Total bp | # of Non-synonymous Indels Present | | | | |
|---|---|---|---|---|---|---|
| | | HS91 | TK #21 | TK #4 | 153-3 | 129PT |
| HSM_0077 | 12192 | 0 | 3 | 2 | * | * |
| HSM_0268 | 7119 | 0 | 1 | 1 | * | * |
| HSM_0270 | 3480 | 0 | * | * | * | * |
| HSM_0274 | 1569 | 0 | 1 | 0 | * | * |
| HSM_0338 | 7260 | 0 | * | * | * | * |
| HSM_0346 | 4653 | 0 | 3 | 3 | * | * |
| HSM_0377 | 9948 | 0 | * | * | * | * |
| HSM_0394 | 9870 | 0 | 1 | 1 | * | * |
| HSM_0695 | 924 | 0 | 0 | 0 | 0 | * |
| HSM_0708 | 11025 | 0 | * | * | * | * |
| HSM_0844 | 9417 | 0 | 6 | 6 | 1 | * |
| HSM_0953 | 1227 | 0 | * | * | 1 | 1 |
| HSM_1022 | 11250 | 0 | 4 | 4 | 1 | 6 |
| HSM_1090 | 5268 | 0 | 3 | 3 | 3 | * |
| HSM_1212 | 1170 | 0 | 0 | 0 | 0 | * |
| HSM_1257 | 13971 | 0 | * | * | * | * |
| HSM_1484 | 6540 | 0 | 3 | 4 | * | * |
| HSM_1542 | 7158 | 0 | 6 | 8 | * | * |
| HSM_1571 | 11772 | 0 | * | 4 | 4 | * |
| HSM_1647 | 2124 | 0 | 0 | 0 | 0 | * |
| HSM_1651 | 8235 | 0 | 2 | 1 | 0 | * |
| HSM_1793 | 8277 | 0 | * | * | * | * |
| HSM_1889 | 2193 | 0 | * | * | 0 | * |

* Indicates when a gene was found to be missing for that particular isolate.

TABLE 20 (6)

Number of indels present in isolates from group 2 analysis of virulence-associated genes involved in adhesion, colonization, or biofilm formation.

| Gene Number | Gene Name | Total bp | # of Non-synonymous Indels Present | | | | | | |
|---|---|---|---|---|---|---|---|---|---|
| | | | TK | HS91 | TK | 2336 | TK | HS91 | 129P |
| HSM_007 | YadA | 12192 | 4 | 0 | * | 0 | * | 0 | * |
| HSM_026 | Filament | 7119 | * | 0 | 1 | 0 | 1 | 0 | * |
| HSM_027 | Hemaggl | 3480 | * | 0 | * | 0 | * | 0 | * |
| HSM_027 | Adhesin | 1569 | * | 0 | 0 | 0 | 0 | 0 | * |
| HSM_033 | YadA | 7260 | 3 | 0 | 5 | 0 | 5 | 0 | * |
| HSM_034 | YadA | 4653 | 7 | 0 | 5 | 0 | 5 | 0 | * |
| HSM_037 | YadA | 9948 | 5 | * | 8 | 0 | 8 | * | * |
| HSM_039 | YadA | 9870 | 0 | 1 | 0 | 0 | 0 | 1 | * |
| HSM_069 | Alkaline | 924 | 0 | 0 | 0 | 0 | 0 | 0 | * |
| HSM_070 | YadA | 11025 | * | 0 | * | 0 | * | 0 | * |
| HSM_084 | YadA | 9417 | 1 | 0 | 5 | 0 | 5 | 0 | * |
| HSM_095 | Hemaggl | 1227 | 1 | 0 | 0 | 0 | 0 | 0 | 1 |
| HSM_102 | YadA | 11250 | * | 0 | 7 | 0 | 7 | 0 | 7 |
| HSM_109 | Filament | 5268 | 2 | 3 | 3 | 0 | 3 | 2 | * |
| HSM_121 | Hemaggl | 1170 | * | 0 | 1 | 0 | 1 | 0 | * |
| HSM_125 | YadA | 13971 | * | 0 | * | 0 | * | 0 | * |
| HSM_148 | YadA | 6540 | 4 | 0 | 1 | 0 | 1 | 0 | * |
| HSM_154 | YadA | 7158 | * | 0 | * | 0 | * | 0 | * |
| HSM_157 | YadA | 11772 | * | 0 | * | 0 | * | 0 | * |
| HSM_164 | FhaB | 2124 | 0 | 0 | 0 | 0 | 0 | 0 | * |
| HSM_165 | Filament | 8235 | 0 | 0 | 0 | 0 | 0 | 0 | * |
| HSM_179 | YadA | 8277 | * | * | * | * | * | 0 | * |
| HSM_188 | Peptidase | 2193 | * | * | 0 | 0 | 0 | * | * |

* Indicates when a gene was found to be missing for that particular isolate.

TABLE 21

Number of indels present in isolates from group 1 analysis of virulence-associated genes involved in host invasion or metal uptake.

| Gene Number | Total bp | # of Non-synonymous Indels Present | | | | |
|---|---|---|---|---|---|---|
| | | HS91 | TK #21 | TK #4 | 153-3 | 129PT |
| HSM_0047 | 2754 | 0 | 0 | 2 | 0 | 1 |
| HSM_0749 | 1989 | 1 | * | * | * | 1 |
| HSM_0750 | 2916 | 0 | 2 | 2 | 2 | 4 |
| HSM_0931 | 1779 | 0 | 0 | 0 | 1 | 0 |
| HSM_1089 | 1353 | 0 | 0 | 0 | 0 | * |
| HSM_1160 | 537 | 0 | 0 | * | 0 | * |
| HSM_1168 | 3111 | 0 | 0 | 0 | 0 | 1 |
| HSM_1176 | 261 | 0 | 1 | 1 | 0 | 2 |
| HSM_1726 | 1548 | 0 | 0 | * | 0 | * |
| HSM_1730 | 1605 | 0 | 0 | 0 | 0 | 0 |
| HSM_1962 | 2607 | 0 | 0 | 0 | 0 | 0 |

* Indicates when a gene was found to be missing for that particular isolate.

TABLE 22

Number of indels present in isolates from group 2 analysis of virulence-associated genes involved in host invasion or metal uptake.

| Gene Number | Total bp | # of Non-synonymous Indels Present | | | | | |
|---|---|---|---|---|---|---|---|
| | | TK | HS91 | TK | 2336 | TK | HS91 | 129P |
| HSM_0047 | 2754 | 2 | 0 | 1 | 0 | 1 | 0 | 1 |
| HSM_0749 | 1989 | * | 0 | 1 | 1 | 1 | 0 | 1 |
| HSM_0750 | 2916 | 2 | 0 | 2 | 0 | 1 | 0 | 3 |
| HSM_0931 | 1779 | 0 | 0 | 0 | 0 | 0 | 0 | 0 |

TABLE 22-continued

Number of indels present in isolates from group 2 analysis of virulence-associated genes involved in host invasion or metal uptake.

| Gene Number | Total bp | # of Non-synonymous Indels Present | | | | | | |
|---|---|---|---|---|---|---|---|---|
| | | TK | HS91 | TK | 2336 | TK | HS91 | 129P |
| HSM_1089 | 1353 | 0 | 0 | 1 | 0 | 1 | 0 | * |
| HSM_1160 | 537 | * | 0 | 0 | 0 | 0 | 0 | * |
| HSM_1168 | 3111 | 0 | 0 | 0 | 0 | 0 | 0 | 1 |
| HSM_1176 | 261 | 2 | 0 | 0 | 0 | 0 | 0 | 2 |
| HSM_1726 | 1548 | 0 | * | * | 0 | * | * | * |
| HSM_1730 | 1605 | 0 | 0 | 0 | 0 | 0 | 0 | 0 |
| HSM_1962 | 2607 | 0 | 0 | 0 | 0 | 0 | 0 | 0 |

* Indicates when a gene was found to be missing for that particular isolate.

TABLE 23

Number of indels present in isolates from group 1 analysis of virulence-associated genes involved in stress response, antibiotic resistance, and drug efflux.

| Gene Number | Total bp | # of Non-synonymous Indels Present | | | | |
|---|---|---|---|---|---|---|
| | | HS91 | TK #21 | TK #4 | 153-3 | 129PT |
| HSM_0598 | 1890 | 0 | * | * | 0 | * |
| HSM_1191 | 573 | 0 | * | * | * | * |
| HSM_1448 | 282 | 0 | 0 | 0 | 0 | * |
| HSM_1616 | 981 | 0 | * | * | 0 | * |
| HSM_1624 | 1029 | 1 | * | * | * | * |
| HSM_1728 | 405 | 0 | * | * | * | * |
| HSM_1734 | 624 | 0 | 0 | * | 0 | * |
| HSM_1736 | 333 | 0 | * | * | * | * |
| HSM_1737 | 450 | 0 | * | * | * | * |
| HSM_1741 | 399 | 0 | * | * | * | * |

* Indicates when a gene was found to be missing for that particular isolate.

TABLE 24

Number of indels present in isolates from group 2 analysis of virulence-associated genes involved in stress response, antibiotic resistance, and drug efflux.

| Gene Number | Total bp | # of Non-synonymous Indels Present | | | | | | |
|---|---|---|---|---|---|---|---|---|
| | | TK | HS91 | TK | 2336 | TK | HS91 | 129PT |
| HSM_0598 | 1890 | * | 0 | 0 | 0 | 0 | 0 | * |
| HSM_1191 | 573 | * | 0 | * | 0 | * | 0 | * |
| HSM_1448 | 282 | 0 | 0 | * | 0 | * | 0 | * |
| HSM_1616 | 981 | 0 | 0 | 0 | 0 | 0 | 0 | * |
| HSM_1624 | 1029 | 2 | 2 | * | 1 | * | 2 | * |
| HSM_1728 | 405 | * | * | * | 0 | * | * | * |
| HSM_1734 | 624 | 0 | * | * | 0 | * | * | * |
| HSM_1736 | 333 | * | * | * | 0 | * | * | * |
| HSM_1737 | 450 | * | * | * | 0 | * | * | * |
| HSM_1741 | 399 | * | * | * | 0 | * | * | * |

* Indicates gene was missing from that particular isolate.

There were many similarities for indels missing among the recent isolates and 129PT for virulence-associated genes involved in host invasion and metal uptake. These genes included TonB-dependent receptor (2 indels for each of TK #4 and TK #34, 1 indel for TK #42, TK #28 and 129PT), TbpB (1 indel each for HS91, TK #42, 2336, TK #28, and 129PT), TbpA (2 indels for TK #21, TK #4, 153-3, TK #34, and TK #42, 3 or 4 indels for 129PT (the two analyses resulted in different indel estimates for this isolate), and 1 indel for TK #28), TbpA2 (1 indel for 153-3), hemolysis activation/secretion protein-like protein (1 indel each for TK #42 and TK #28), TonB-dependent hemoglobin/transferrin/lactoferrin family receptor (1 indel for 129PT), and an outer membrane hemin receptor protein (1 indel for TK #21 and TK #4, 2 indels for TK #34 and 129PT). The only gene among the stress response, antibiotic resistance, and drug efflux genes to have any indels was acyltransferase 3. There was 1 non-synonymous indel in HS91 and 2336, and there were 2 in TK #34, HS91 ΔaroC, and HS91 ΔnanPU.

* * *

Having thus described in detail preferred embodiments of the present invention, it is to be understood that the invention defined by the above paragraphs is not to be limited to particular details set forth in the above description as many apparent variations thereof are possible without departing from the spirit or scope of the present invention.

SEQUENCE LISTING (6 sequences)

SEQ ID NO: 1 - DNA, 2263857 bp, Histophilus somni (TK #4)
  misc_feature (78208)..(78483): n is a, c, g, or t
  misc_feature (79477)..(79477): n is a, c, g, or t
  misc_feature (80066)..(80066): n is a, c, g, or t
  misc_feature (81341)..(81426): n is a, c, g, or t
  misc_feature (81679)..(81825): n is a, c, g, or t
  misc_feature (81904)..(82061): n is a, c, g, or t
  misc_feature (86391)..(86418): n is a, c, g, or t
  misc_feature (86686)..(86686): n is a, c, g, or t
  misc_feature (87654)..(87787): n is a, c, g, or t
  misc_feature (88111)..(88269): n is a, c, g, or t
  misc_feature (88372)..(88608): n is a, c, g, or t
  misc_feature (89032)..(89036): n is a, c, g, or t
  misc_feature (96692)..(98187): n is a, c, g, or t
  misc_feature (240582)..(250622): n is a, c, g, or t
  misc_feature (251118)..(256363): n is a, c, g, or t
  misc_feature (256776)..(264353): n is a, c, g, or t
  misc_feature (274134)..(274139): n is a, c, g, or t
  misc_feature (285861)..(285889): n is a, c, g, or t
  misc_feature (287250)..(288947): n is a, c, g, or t
  misc_feature (290094)..(290094): n is a, c, g, or t
  misc_feature (291020)..(293227): n is a, c, g, or t
  misc_feature (293512)..(295361): n is a, c, g, or t
  misc_feature (306137)..(306152): n is a, c, g, or t
  misc_feature (318228)..(318862): n is a, c, g, or t
  misc_feature (334146)..(336310): n is a, c, g, or t
  misc_feature (343724)..(343839): n is a, c, g, or t
  misc_feature (362219)..(362421): n is a, c, g, or t
  misc_feature (362551)..(362570): n is a, c, g, or t
  misc_feature (362642)..(362667): n is a, c, g, or t
  misc_feature (362807)..(363466): n is a, c, g, or t
  misc_feature (363540)..(363728): n is a, c, g, or t
  misc_feature (363881)..(363888): n is a, c, g, or t
  misc_feature (364143)..(365041): n is a, c, g, or t
  misc_feature (365653)..(365683): n is a, c, g, or t
  misc_feature (365790)..(365999): n is a, c, g, or t
  misc_feature (379886)..(379886): n is a, c, g, or t
  misc_feature (381127)..(381424): n is a, c, g, or t
  misc_feature (382320)..(382566): n is a, c, g, or t
  misc_feature (423702)..(423702): n is a, c, g, or t
  misc_feature (423851)..(423921): n is a, c, g, or t
  misc_feature (424189)..(424256): n is a, c, g, or t
  misc_feature (424290)..(424695): n is a, c, g, or t
  misc_feature (424862)..(424988): n is a, c, g, or t
  misc_feature (425034)..(425112): n is a, c, g, or t
  misc_feature (425303)..(425427): n is a, c, g, or t
  misc_feature (425596)..(426525): n is a, c, g, or t
  misc_feature (426564)..(426607): n is a, c, g, or t
  misc_feature (426830)..(427572): n is a, c, g, or t
  misc_feature (427629)..(427905): n is a, c, g, or t
  misc_feature (428778)..(428801): n is a, c, g, or t
  misc_feature (428940)..(428992): n is a, c, g, or t
  misc_feature (429742)..(429850): n is a, c, g, or t
  misc_feature (453808)..(454225): n is a, c, g, or t
  misc_feature (454442)..(454492): n is a, c, g, or t
  misc_feature (454586)..(454807): n is a, c, g, or t
  misc_feature (454895)..(455103): n is a, c, g, or t
  misc_feature (455340)..(455340): n is a, c, g, or t
  misc_feature (455342)..(455342): n is a, c, g, or t
  misc_feature (455775)..(455914): n is a, c, g, or t
  misc_feature (456273)..(456329): n is a, c, g, or t
  misc_feature (456679)..(456679): n is a, c, g, or t
  misc_feature (457661)..(457716): n is a, c, g, or t
  misc_feature (457770)..(457784): n is a, c, g, or t
  misc_feature (459187)..(459286): n is a, c, g, or t
  misc_feature (467773)..(468629): n is a, c, g, or t
  misc_feature (481781)..(481812): n is a, c, g, or t
  misc_feature (513671)..(518980): n is a, c, g, or t
  misc_feature (519062)..(519792): n is a, c, g, or t
  misc_feature (520101)..(524825): n is a, c, g, or t
  misc_feature (542124)..(542195): n is a, c, g, or t
  misc_feature (552271)..(552359): n is a, c, g, or t
  misc_feature (552749)..(552789): n is a, c, g, or t
  misc_feature (552932)..(553027): n is a, c, g, or t
  misc_feature (553297)..(553381): n is a, c, g, or t
  misc_feature (559245)..(562899): n is a, c, g, or t
  misc_feature (563336)..(568107): n is a, c, g, or t
  misc_feature (607285)..(607586): n is a, c, g, or t
  misc_feature (607762)..(607763): n is a, c, g, or t
  misc_feature (614920)..(618334): n is a, c, g, or t
  misc_feature (630221)..(634397): n is a, c, g, or t
  misc_feature (664966)..(665370): n is a, c, g, or t
  misc_feature (665529)..(665880): n is a, c, g, or t
  misc_feature (672544)..(676938): n is a, c, g, or t
  misc_feature (692212)..(693279): n is a, c, g, or t
  misc_feature (693611)..(695071): n is a, c, g, or t
  misc_feature (695447)..(697595): n is a, c, g, or t
  misc_feature (697898)..(699567): n is a, c, g, or t
  misc_feature (699813)..(700909): n is a, c, g, or t
  misc_feature (700961)..(701215): n is a, c, g, or t
  misc_feature (701327)..(701561): n is a, c, g, or t
  misc_feature (701591)..(701591): n is a, c, g, or t
  misc_feature (704985)..(706024): n is a, c, g, or t
  misc_feature (706255)..(708250): n is a, c, g, or t
  misc_feature (708460)..(710080): n is a, c, g, or t
  misc_feature (743639)..(743772): n is a, c, g, or t
  misc_feature (807060)..(807098): n is a, c, g, or t
  misc_feature (807737)..(808177): n is a, c, g, or t
  misc_feature (808249)..(808658): n is a, c, g, or t
  misc_feature (808711)..(809436): n is a, c, g, or t
  misc_feature (809699)..(810521): n is a, c, g, or t
  misc_feature (811539)..(811574): n is a, c, g, or t
  misc_feature (811752)..(811772): n is a, c, g, or t
  misc_feature (811890)..(813637): n is a, c, g, or t
  misc_feature (813767)..(815215): n is a, c, g, or t
  misc_feature (815421)..(815621): n is a, c, g, or t
  misc_feature (856784)..(856784): n is a, c, g, or t
  misc_feature (862746)..(863422): n is a, c, g, or t
  misc_feature (863624)..(863703): n is a, c, g, or t
  misc_feature (924643)..(924736): n is a, c, g, or t
  misc_feature (926933)..(928313): n is a, c, g, or t
  misc_feature (932646)..(932646): n is a, c, g, or t
  misc_feature (936227)..(938500): n is a, c, g, or t
  misc_feature (938874)..(946008): n is a, c, g, or t
  misc_feature (971205)..(971303): n is a, c, g, or t
  misc_feature (971725)..(971796): n is a, c, g, or t
  misc_feature (971987)..(972061): n is a, c, g, or t
  misc_feature (972139)..(972171): n is a, c, g, or t
  misc_feature (972228)..(972228): n is a, c, g, or t
  misc_feature (972232)..(972232): n is a, c, g, or t
  misc_feature (972284)..(972284): n is a, c, g, or t
  misc_feature (972289)..(972289): n is a, c, g, or t
  misc_feature (972312)..(972417): n is a, c, g, or t
  misc_feature (972934)..(972970): n is a, c, g, or t
  misc_feature (973126)..(973151): n is a, c, g, or t
  misc_feature (974239)..(974324): n is a, c, g, or t
  misc_feature (975059)..(975091): n is a, c, g, or t
  misc_feature (975186)..(975346): n is a, c, g, or t
  misc_feature (975535)..(975536): n is a, c, g, or t
  misc_feature (975540)..(975540): n is a, c, g, or t
  misc_feature (975550)..(975550): n is a, c, g, or t
  misc_feature (975621)..(975636): n is a, c, g, or t
  misc_feature (978176)..(978238): n is a, c, g, or t
  misc_feature (978640)..(978679): n is a, c, g, or t
  misc_feature (980066)..(980066): n is a, c, g, or t
  misc_feature (981649)..(981729): n is a, c, g, or t
  misc_feature (981832)..(983093): n is a, c, g, or t
  misc_feature (986049)..(990315): n is a, c, g, or t
  misc_feature (991468)..(992180): n is a, c, g, or t
  misc_feature (1001011)..(1002293): n is a, c, g, or t
  misc_feature (1003444)..(1004464): n is a, c, g, or t
  misc_feature (1005002)..(1005882): n is a, c, g, or t
  misc_feature (1006951)..(1007229): n is a, c, g, or t
  misc_feature (1007446)..(1008536): n is a, c, g, or t
  misc_feature (1008582)..(1009411): n is a, c, g, or t
  misc_feature (1009454)..(1011971): n is a, c, g, or t
  misc_feature (1012399)..(1012842): n is a, c, g, or t
  misc_feature (1013795)..(1014685): n is a, c, g, or t
  misc_feature (1015248)..(1015465): n is a, c, g, or t
  misc_feature (1015533)..(1016185): n is a, c, g, or t
  misc_feature (1016377)..(1018500): n is a, c, g, or t
  misc_feature (1021912)..(1022170): n is a, c, g, or t
  misc_feature (1022207)..(1022253): n is a, c, g, or t
  misc_feature (1022324)..(1022417): n is a, c, g, or t
  misc_feature (1035314)..(1035532): n is a, c, g, or t
  misc_feature (1035772)..(1035844): n is a, c, g, or t
  misc_feature (1035881)..(1035964): n is a, c, g, or t
  misc_feature (1036715)..(1037239): n is a, c, g, or t
  misc_feature (1048153)..(1048367): n is a, c, g, or t
  misc_feature (1048767)..(1049176): n is a, c, g, or t
  misc_feature (1070502)..(1070502): n is a, c, g, or t
  misc_feature (1090214)..(1090522): n is a, c, g, or t
  misc_feature (1090629)..(1090629): n is a, c, g, or t
  misc_feature (1090640)..(1090640): n is a, c, g, or t
  misc_feature (1090759)..(1090793): n is a, c, g, or t
  misc_feature (1170142)..(1170384): n is a, c, g, or t
  misc_feature (1172147)..(1172235): n is a, c, g, or t
  misc_feature (1175277)..(1175750): n is a, c, g, or t
  misc_feature (1176092)..(1176154): n is a, c, g, or t
  misc_feature (1176365)..(1176458): n is a, c, g, or t
  misc_feature (1176794)..(1176933): n is a, c, g, or t
  misc_feature (1177273)..(1177532): n is a, c, g, or t
  misc_feature (1177629)..(1177931): n is a, c, g, or t
  misc_feature (1188712)..(1195019): n is a, c, g, or t
  misc_feature (1195321)..(1195495): n is a, c, g, or t
  misc_feature (1301869)..(1313315): n is a, c, g, or t
  misc_feature (1313914)..(1314128): n is a, c, g, or t
  misc_feature (1314785)..(1322889): n is a, c, g, or t
  misc_feature (1323873)..(1324759): n is a, c, g, or t
  misc_feature (1325072)..(1325760): n is a, c, g, or t
  misc_feature (1325835)..(1325908): n is a, c, g, or t
  misc_feature (1326167)..(1328247): n is a, c, g, or t
  misc_feature (1328727)..(1329960): n is a, c, g, or t
  misc_feature (1340125)..(1352087): n is a, c, g, or t
  misc_feature (1368237)..(1368949): n is a, c, g, or t
  misc_feature (1370174)..(1370211): n is a, c, g, or t
  misc_feature (1417386)..(1418745): n is a, c, g, or t
  misc_feature (1419411)..(1419411): n is a, c, g, or t
  misc_feature (1419742)..(1419786): n is a, c, g, or t
  misc_feature (1419988)..(1419988): n is a, c, g, or t
  misc_feature (1419990)..(1419990): n is a, c, g, or t
  misc_feature (1420713)..(1420754): n is a, c, g, or t
  misc_feature (1422415)..(1422665): n is a, c, g, or t
  misc_feature (1427707)..(1429083): n is a, c, g, or t
  misc_feature (1429305)..(1429357): n is a, c, g, or t
  misc_feature (1429482)..(1431000): n is a, c, g, or t
  misc_feature (1441632)..(1441911): n is a, c, g, or t
  misc_feature (1443262)..(1444093): n is a, c, g, or t
  misc_feature (1530876)..(1532616): n is a, c, g, or t
  misc_feature (1535194)..(1535205): n is a, c, g, or t
  misc_feature (1558344)..(1558344): n is a, c, g, or t
  misc_feature (1630856)..(1631307): n is a, c, g, or t
  misc_feature (1647215)..(1647264): n is a, c, g, or t
  misc_feature (1649423)..(1650067): n is a, c, g, or t
  misc_feature (1650367)..(1650928): n is a, c, g, or t
  misc_feature (1651503)..(1651714): n is a, c, g, or t
  misc_feature (1653270)..(1653319): n is a, c, g, or t
  misc_feature (1689806)..(1689923): n is a, c, g, or t
  misc_feature (1690734)..(1690928): n is a, c, g, or t
  misc_feature (1691563)..(1691563): n is a, c, g, or t
  misc_feature (1691566)..(1691566): n is a, c, g, or t
  misc_feature (1691596)..(1691596): n is a, c, g, or t
  misc_feature (1691599)..(1691599): n is a, c, g, or t
  misc_feature (1691609)..(1691854): n is a, c, g, or t
  misc_feature (1709998)..(1710102): n is a, c, g, or t
  misc_feature (1737165)..(1737212): n is a, c, g, or t
  misc_feature (1747647)..(1749384): n is a, c, g, or t
  misc_feature (1752075)..(1753776): n is a, c, g, or t
  misc_feature (1754066)..(1754195): n is a, c, g, or t
  misc_feature (1770224)..(1770257): n is a, c, g, or t
  misc_feature (1770389)..(1770656): n is a, c, g, or t
  misc_feature (1771745)..(1771917): n is a, c, g, or t
  misc_feature (1774054)..(1774175): n is a, c, g, or t
  misc_feature (1775003)..(1775141): n is a, c, g, or t
  misc_feature (1775291)..(1775350): n is a, c, g, or t
  misc_feature (1776100)..(1776100): n is a, c, g, or t
  misc_feature (1806497)..(1806556): n is a, c, g, or t
  misc_feature (1807126)..(1808736): n is a, c, g, or t
  misc_feature (1812820)..(1812976): n is a, c, g, or t
  misc_feature (1813846)..(1813928): n is a, c, g, or t
  misc_feature (1814113)..(1814113): n is a, c, g, or t
  misc_feature (1814124)..(1814124): n is a, c, g, or t
  misc_feature (1814297)..(1814297): n is a, c, g, or t
  misc_feature (1814299)..(1814299): n is a, c, g, or t
  misc_feature (1815617)..(1815862): n is a, c, g, or t
  misc_feature (1816071)..(1816186): n is a, c, g, or t
  misc_feature (1816240)..(1816304): n is a, c, g, or t
  misc_feature (1816480)..(1816604): n is a, c, g, or t
  misc_feature (1817524)..(1817677): n is a, c, g, or t
  misc_feature (1847212)..(1847269): n is a, c, g, or t
  misc_feature (1864711)..(1865746): n is a, c, g, or t
  misc_feature (1865855)..(1866303): n is a, c, g, or t
  misc_feature (1866485)..(1866896): n is a, c, g, or t
  misc_feature (1869364)..(1869790): n is a, c, g, or t
  misc_feature (1870899)..(1871335): n is a, c, g, or t
  misc_feature (1871668)..(1871959): n is a, c, g, or t
  misc_feature (1872655)..(1877886): n is a, c, g, or t
  misc_feature (1882409)..(1882409): n is a, c, g, or t
  misc_feature (1892371)..(1892386): n is a, c, g, or t
  misc_feature (1892840)..(1893212): n is a, c, g, or t
  misc_feature (1894204)..(1894285): n is a, c, g, or t
  misc_feature (1894655)..(1895192): n is a, c, g, or t
  misc_feature (1902581)..(1902694): n is a, c, g, or t
  misc_feature (1911403)..(1911528): n is a, c, g, or t
  misc_feature (1922073)..(1924860): n is a, c, g, or t
  misc_feature (1925032)..(1927802): n is a, c, g, or t
  misc_feature (1927919)..(1935559): n is a, c, g, or t
  misc_feature (1936039)..(1941154): n is a, c, g, or t
  misc_feature (1941211)..(1944281): n is a, c, g, or t
  misc_feature (1944311)..(1946016): n is a, c, g, or t
  misc_feature (1946444)..(1947097): n is a, c, g, or t
  misc_feature (1947308)..(1947341): n is a, c, g, or t
  misc_feature (1947450)..(1955601): n is a, c, g, or t
  misc_feature (1955652)..(1955706): n is a, c, g, or t
  misc_feature (1955958)..(1956174): n is a, c, g, or t
  misc_feature (1956273)..(1956297): n is a, c, g, or t
  misc_feature (1956378)..(1956429): n is a, c, g, or t
  misc_feature (1956489)..(1958206): n is a, c, g, or t
  misc_feature (1958314)..(1958410): n is a, c, g, or t
  misc_feature (1958499)..(1962051): n is a, c, g, or t
  misc_feature (1962186)..(1962322): n is a, c, g, or t
  misc_feature (1962512)..(1963559): n is a, c, g, or t
  misc_feature (1963637)..(1964161): n is a, c, g, or t
  misc_feature (1964228)..(1964300): n is a, c, g, or t
  misc_feature (1964463)..(1966015): n is a, c, g, or t
  misc_feature (1966061)..(1972231): n is a, c, g, or t
  misc_feature (1972398)..(1972476): n is a, c, g, or t
  misc_feature (1972567)..(1986478): n is a, c, g, or t
  misc_feature (1986863)..(1986900): n is a, c, g, or t
  misc_feature (1986959)..(1991720): n is a, c, g, or t
  misc_feature (1991896)..(1991896): n is a, c, g, or t
  misc_feature (1991908)..(1991908): n is a, c, g, or t
  misc_feature (1991914)..(1991914): n is a, c, g, or t
  misc_feature (1991926)..(1991926): n is a, c, g, or t
  misc_feature (1991932)..(1991932): n is a, c, g, or t
  misc_feature (1991935)..(1991935): n is a, c, g, or t
  misc_feature (1991943)..(1991943): n is a, c, g, or t
  misc_feature (1991950)..(1991950): n is a, c, g, or t
  misc_feature (1991956)..(1991956): n is a, c, g, or t
  misc_feature (1992082)..(1992221): n is a, c, g, or t
  misc_feature (1992327)..(1994518): n is a, c, g, or t
  misc_feature (2038640)..(2039902): n is a, c, g, or t
  misc_feature (2040072)..(2040304): n is a, c, g, or t
  misc_feature (2040368)..(2040606): n is a, c, g, or t
  misc_feature (2040710)..(2040965): n is a, c, g, or t
  misc_feature (2041004)..(2041219): n is a, c, g, or t
  misc_feature (2041471)..(2042226): n is a, c, g, or t
  misc_feature (2042587)..(2043645): n is a, c, g, or t
  misc_feature (2044168)..(2044226): n is a, c, g, or t
  misc_feature (2044387)..(2044657): n is a, c, g, or t
  misc_feature (2044933)..(2045029): n is a, c, g, or t
  misc_feature (2118900)..(2123413): n is a, c, g, or t
  misc_feature (2123780)..(2123974): n is a, c, g, or t
  misc_feature (2124728)..(2137637): n is a, c, g, or t
  misc_feature (2138635)..(2139214): n is a, c, g, or t
  misc_feature (2139320)..(2143906): n is a, c, g, or t
  misc_feature (2160506)..(2163041): n is a, c, g, or t
  misc_feature (2186341)..(2186437): n is a, c, g, or t
  misc_feature (2230137)..(2230241): n is a, c, g, or t
atcaaaaacaacgctcatcaaaaattaagaagcggaattctaatcttaaattcagcgttcgtcaaatcagaatagtcaaaatcgcagaataaagcttatttttccaatcaaaaagcacaagagcggctcggattatacgtttttttacaaaaatctcaagcaacctttttcagtttttttgttcttttaataaagatctttgagccagtttattgtagaattaccctcaatttacaccgcacttttagataaaacttccaactatttaatttgcaaagatggataaaatgagttcaacagtttctacgctatggcgagattgcttattacaattacaagatcaagtatcttcaaatgactttacgacttggctacgaccattacaggacgatgtcagtgagagtaacatgatactttatgcaccaaattgtttcattaaaggatgggttgaaaatcattatctcactcaaatcacaaagcttgctcagcaattgttgaataatgatcaattcatggtaaagatacaagacggcataaaacctactgagaaaacaacaacgaatgttgagcaaaagacacaaaatgaaaactgtcataatgaaataacttcgcaacaaaattaccgctcttatctcaataaaaatcatgtctttgataactttgttgaaggtaaatctaaccaattggcacgagcagttgcccagaaagtggctaaaaatccgggtgagcaaagtgctaatccattgtttttgtatggtggtacaggtctaggcaaaacgcacctgttgcatgctgtaggaaacggcattttagcaaataatcctcatgctcaagttgtttatatgcatgcagaacgttttatgcaatcttatgtaaaagccttaaaatccgatagaatggacagttttaagcgattttatcgtactgttgatgccttactgattgatgatattcaattttttgccggtaaagatggtacgcaagaagaatttttccatatattcaactcgttatttgagcgtggtcgccaaattattttgacttctgatcgttatccgaaggaaattgagaaaattgaagatcgtttaaaatctcgtttcggttggggaattagtgttgctattgaacctcccgaattggaaactagagtcgcgattttgttgaagaaagcggaagaaaaaaatatggttttacccgaagaggtcgccatgtttattgggggaaaattacgtactaatgtgcgagaattagaaggtgcattaaaccgtgttcatgcacatgcggaatttaccggaaaagcgattactattgattttgtacgtgaaactctaaaagacatgttggcattgcaagataaattggtaacaattgaaaatattcaaaaaattgtggcggattattatcggatcaaaatttcggatttaaaatcaaaaagacgttcacgtaatataaccagaccacgtcaattagctatggcattagctaaagaactaacgaatcgcagtcttcctgaaattggtaggaatttcggtgatcgggatcatacgaccgttctgcatgcttgtaaggccatagcaaaactccgagaagaagataatggtatccaagaagattggtcaaatttaatccgcacactgtcagtataagggagcagactatgcaatttattgtttcaagagaacatctattaaaaccattacaacaagtttgtggtgtattaagtagtcgtccaaattttcctatattaaacaatgtattattgcaaattgaggggaatgttttacgtattaccggtacagatctcgaagtagaactttcaacacaagcacaacttattcaagcatcgcaagacggtagttatacgattccggcaaaaaaattcttagatatttgccgcagttttcccgatgaagcggaaattactgtaatttttgaagaagagcgtgcattggtgagatccggtcgaagtaaatttaatttaaccgctttacctgcagacgaatatcctaatttagctgattggcaatcagaggtggatttttacctgcctcaaagtacattacgtcgcctaattgaagcaacacaattctctatggcaaaccaagatgctcgttatttcctaaacggtatgaagtttgaaactgaaggcaatttactacgaacagttgctactgatggacatcgactcgccgtttgcacaattccgttagagcaggatttgcatacacatgcagtcattttgcctcgcaaaggaatattagagttaatgagattactggaaaacagcgaacacgctgctcacgttcaaattggcacaaataatttacgcattgatttaggaagtattatttttacatcaaaattaattgatggtcgtttcccagactatcgtagagttctcccaagaaatgcaactcatattatggaaggtaattgggaactgctgaaacaagcttttgctcgtatggcaattctgtctagcgataaagttaaaactgtccgtttgcaattgacctcaaatcaattaaagattacagcaacaaatccggaacaagaagtggctgaggaaattttagatgtcgtatataatggggcagatatggaagttggctttaatgtgagttacattttagatgtacttaatgccctaaaatgccaacaggtgcgattatgttttactgatgcctcatcaagttgtttattagaggatgctgatgatgaaagtgcagagtatgtcgttatgccgatgcgtctataaacaatggcaatatcacgcttaatcatcaatcatttccgcaacttaacagccatagatctggaatttgaacgtggctttaactttattattggcaacaatggaagcgggaaaacaagtttactggaagctattttttatttagggcatggacgctcatttaaaagtgcggttgcaaatagaataatttcttatcagcaaccgcactttattttacatggtaaaattcaagagcaacaacatcaatggtctgttggtttgcaaaaacaacgtcaaggtaacactttaatgaaaataaacggcgaggacgcaaaaaaaatttccgatcttgcccatttattgcccatgcaactcattacacctgaaggattaaccttattaaatggcggtcccagctatcgaagggcttatttagattgggggttatttcatcataacgcatcattttataatgcttggagtagcttaaatcgtttacttaaacaacgaaattctgccttgcaacaagtttgttcttatgaaaaactcaaaatttgggatagagaattagccaaacttgcttatcaagtgagctactggcgagaagcgtatgcggaagctttacgctcggaaatagaaaaaacctgtcagctttttctacctgaactagaaatttctgttagctttcatcaaggctgggataaaaatatggactatgcggatctgttacaacaaaactttgagcgagatcgtgctttgggttataccttttccggacctcaaaaagcagattttcgttttaaagcaaacggattgccggttgaagatattttatctcgaggacaattaaaattgttaatgtgtgcattacgtttggctcaaggtgagcatttaatgcaacaaaaaaaacgccactgtatttttctacttgacgatttcgcttcagaattggatcaatataaacgcacattgcttgctgaacgcttacaaaaaaatggttcgcaagtttttgttactgcaataactcaagaacaattacaacagatacaaccagaaaagcaccgcactttttaccttgaaaacggaagaataaaagatctttaaaataagcaaaaaataaacctgaccaattgtcaggcttcacatagcgttataaagatttatcttgtaccatacacaacaatagttttgccatgtgctgaaatcaaatgctgatcttctaacattttcaaaatacgcccaacagtttctcgtgagcaacctaccatttgtcctatttcctgacgagtaattttaatttgcataccgtccggatgagtcattgcatcaggcatcttagctaaatttaacaaggtttgagcgatacgacctgtcacatctaaaaatgccagattgcttacctgctttgaagtattttgtaaacgatgagctaattgaccggctaaatacattaaaatttctggattaacttgaattaattggcgaaattttttataagaaatttctgcaatttcacatgagcttttagctttaacccaagccgaacgaggctgtgtttcatcaaataaaccagcttcgccaaaaaaatcaccttgacttaaataagtcaaaatcatttctttaccttcctcatcttttaccatcacggcaacagaccctctaattaaataataaagggtttccgctttttctccagcatgaatgagggagctttttgctgagtatttatgaatgtgacaatgagataggaaccactctaacgtcggatccatcgatggtgctgattgtccttgttgttctaacataaaatctcctagtcattttccatttaaaaaatccattttatttttaatatcaatggattgatgtaactcagaccaaactagtatcgctttcccctgacgaatgtttttaaataaattttctcttttttcggctaatgaaagctcggtactaccataatccgtaccttcacgtaaaataaagctatccacaatatttaataaggtctgctcttctaatttttcccatggaataagcattgcaaattgctccaatcttacctaaaaatttctattatgcaaataaactttccagcagtttccattgttgctcaaaaccttgattaggcaagtgcctaaagttatttcttacgtaacgcataaactgtccctcgcataaagtaacaagatgggaagcaataattttttcatcaagatgaaaagattttccttctctcaatttacgcatttgtagaatattcacaaactgtaattctaaacgatcaaaaaatcgtgcaactcgtgcttgtaactgactatcttcaaacattaaagcatgccctgttaaaattcgggttaatcccggattttttcgtgcaaaatcaagaatagtttgcaaaatatctctcacacgattcatggtattggtttcgttcttgatagagtgattaattcgactaaataaagtattttctatattatccaataatgcttcaaacattttggttttactgggaaaataacggtaaagtgcggcttcagaaacaccgacttcctgtgccaagcgagctgtcgtcatacgctccattcctcgttctgaatgtaacatatgggttagtacggttaatacctgttgacgacgttcttttactgttcgtttctcaattttttgcgttttttgttttgaggcaacaacgatttcagcatcgccaatatccaattgctgttgttccattattttttgcctgaatgaccaaaaccaccattaccacgatctgtttgctgaaattcttctacaatattgaactcagcttgtactacaggtacaaacactaattgtgcgatacgatcaccaatttcgattttgaaaggtttatcacttcgattccaaagagaaaccatgagtggaccttgataatctgaatcgattaaaccaactaaattgcctaatacaatcccatttttatgtcccaatcctgaacgaggcaaaatcactgctgctaaattaggatctgcaatataaatagataaacctgttgaaataagttttgtttctcctggctggacttcaaatccctcgtcaaccaacgctcgtaaatccaatcctgccgatcctatggttgcataagttggtaatggaaactcagttccaatacgtggatctaaaatttttacatcaatctttttcatttactttcttccaatttccatttataacgcacaataattttatcaaccaattgtttagctaagtcacttttatgtttcaatgccaacctctcttgcccattttgccaaaacagctgcaattcgttttgctctgaattaaatacttgcccaccggaaacatcatttgcacaaatcatatccaaatttttacgttgtaatttgtctttcgcatactgctccacattttgtgtttcagccgcaaatcctacaacaaaaggacgattttccattaaattggctacagttgcaagaatgtctggatttttgaccaactttaagaccatttcatcattaccggggattttcttaattttttgttctgcaatttgttctacacgataatcagctaccgctgcacaaccaataaaaatctgattttgttccgcactttgtattgcatgttgatacatttcttgtgccgaaactacattaatgcgttgtacattatgaggtgtcgctaaattgacaggtccactgattaaagtgacttttgcacctcgttgagcaaaagcttcagcaatagcaaaccccattttgcctgagctatgattactaatatagcgtaccggatcaatggcttctcttgttggacctgcggtaatcacaacacttacatcaagtaaatcttgagtatgtaaaaaggattggcaaagtgcggtaaaaatttcaaaaggttctgacattcttccgatacctacatcaccacaagcctgttcaccactattcggtccgataaactgcacaccacgagccatgagttgtgctaaattttgttgagtaacagtttgtgcatacatttgttggttcattgccggagccagaaaaatcggagaattcgttgctagacaaatagtggataataaatcgtttgccataccgaccgccatgcgtgcaataaagtctgcactggcaggtgcaattacgataagatccgcccacttagccaattcaatatgtcccattgccaattcagcttcatgatcaagtaaagattgtgatacagcgttgccggaaattgcttgtaaagttaaaggtgttacaaattctgtcgctgcatttgttagcactactcgaacttctgcttgtgctttacgcaataaacgaattaattctatggttttatatgcagcaataccgccggtaattccaatgacaattcgttttccccgaataagattttgcattgttagtccttaatcacaatccaaagtgcggtcattttactgcaatttttcataagaaaacatttaattttgcgattttgcacgcaaaataaaaaatacagtatttaaaacagcaacaaatcccttcatctttatcgttaaatattttttcctttgctaacaagaattttctatgacacaacaaaatacaactttaatgccgagagaaaaactactgaaatatggagcttcatcacttgatgataaggaattattagcgattttcttacgtacaggtataaaaaattgtcctgttatgcaactctccgagttggtacttgctcatttttcttctttaagaggattaattaatgcagatcaaaagcatttttgccaaatgaaaggattgggtattactcaatttgtacaattacaagcctgtactgaaatgaccaaacgttatctcttacaagaattacagtttgcacaagaatttaccagccctgatacagttcgtatgtatttacagactgaattggaaaataaagatagagaaatttttatggtactgtttttggataatcaacatcgtttaataaaaaaagaggaaatgtttttaggtaccattaaccaggcaaatgtttatcctcgtgagattattaaaacagcactattttgtaatgcagccgcacttattcttgcacataatcatccttccggtgtttcaacgccaagcatggcagacagaaaaatgaccgagaatataaaacaactatcagaattaatggaaatccgtgttttagatcattttatcattggtaaaggtaactatttctcctttgcagaacaaggctggatctaggatcattcgatgaattattcaatctatttgcgtaaatttttatcatttttttcagggaatttatctatttaggcttgagaatgataaacaaaggtcgtataattcacgacctttaatatagtgggtcggctatgcgacctgacgaggtagccttcaaaatcttgaattttgaagtggtccgaaccctaagctcgagcttatatttttattggagattaatatgtctagagtctgtcaagtaacaggcaagcgtccagcagttggtaacaaccgttcgcacgcaatgaatgcgactcgtcgtcgttttcttcctaacttacacactcaccgtttttgggttgagagtgaaaaacgtttcgtaactttacgcttaacagcgaaaggtatgcgtattattgataaaaaaggcattgatgcagtgttggctgaaatccgtgctcgtggcgagaaaatctaaggagctaaaaaatggcagctaaaggtgctcgtgaaaaaattcgcttagtttcaacagctgaaacaggtcatttttatacaacgactaaaaataaacgcaatatgccagaaaaaatggagatcaaaaaatttgatccggttgtgcgtaagcatgttatttacaaagaagctaaaatcaaataatttagttttcacgataaaaaagcccgacatgttcgggttttttattttttcaaattttactttttgccataagatagctgaaagacttactcttggaaaaaaaatatgcctgaattacctgaagttgaaacaaccttaaagggcgtaagcccttatttaaaagggtttataattgaaaaaatagtagtacgtaatcccaaattacgctgggaagtaagtaaagaactcagcacatttaaacacgttaaaattcttaacttaactcgtcgagccaagtatctcattatccacacggaacaaggttacattatcggacatttaggtatgtccggttcagtccgcattgtgccgcatgacaatcctgtcaataagcatgatcatttcgatattgttatgaacaacggcaagttactacgctataacgatgctcgtcgctttggtgcttggctatggacgaataaccttagtgaatttcatctttttttcaagttgggaccggaacctttatctgaaacgtttaattctacttatttgttcaaaaaatctcgtcaaaaaagcaccgcacttaaaactttcttgatggataattccgttgttgtaggggttggaaatatttatgcgaatgaaattttatttctatgtggacttcatccacaaaagatcgccaaaacattgacaaaaaaacaggctgaacaacttgtttttactattaaacaagtgcttaacgaagctattgaacaaggaggaacaaccctaaaagattttttacaacctgacggtcgccccggatattttgctcaaaaacttttggtttatggaaataaggacaagccttgtccaaggtgcggtacaaagataaaaagtattattattgggcaaagaaatagctttttttgtccgcaatgtcaaaaaaagtgacattattttctttgtttttaaaaaaaaatatgctaaacatcaataatgtctttttattttcacaatcagtaaacgcaaaaaggaatatgtaatgaatggagcaaatttggtcgtagaatgtttaaaagctcacggcgtaacttccttatttggctatcccggtggggcgataatgccagtttatgatgcaatttatgattctggtttagatcatctactttgtcgtaatgagcaaggtgcagcaatggctgctattggatatgcaagatcaacaaataaagtcggtgtttgtattgcgacgtcgggaccgggggcaacaaatttaattaccggtttaggtgatgccttgatggattcaattcccattattgcaattaccggacaagttgcctcaaattttatcggtacagatgctttccaggaagctgatattcttgggttgtcacttgcctgtactaagcacagttttatcgttcaacatattgatgaattacctgaaatcattgcgaaagctttccaaattgcacaaagtggtcgtcccggtcctgtgcttattgatcttccaaaagatgtgcaatttgcacctacatccttaaaacccattgtttatcccaaaattgcggattctttacaaaatttagtcgcacttgagcaagcgaaaaatttactttctcaagcaaaacgccctgtgctttatgtaggtggcggtgttggaatggcaaaaagctcggatggtatgagtggcgtaaaagctatacgcacttttcttgatataacaaatattccgtcagtatcaaccttaaaaggtttaggaacaatacctctaaaacatccactctatatgggaatgattggaatgcacggtacaaaagcggcaaattatgctgtgcaagaatgtgatttacttattgcttgtggggcaaggtttgatgatcgtgtaacgggaaaattagatacgtttgcaccacatgctaaagttattcatattgatattgatgttgctgaaattaacaaactccgtaaagcagatgttggactacaaggggatttggtggaggcggttactaaccttgcccaactattggatattgaaccgtggcgtaaagatattgagcagttaaaagcaagttttgattttaattatattgaaaatacagaagataaagagatagagccctgtgcattacttcacacattatccgaacgcaaagcaaaaaatgcggtgattacaactgatgtagggcaacatcagatgtggtcggcacaacatatgaaacattatgaacctgaaaattatattacatctgcagggttcggttcgatgggcttcggtttgccggcagctatcggtgcggcaaaagctcgtccccaagatccagttattttaattactggtgatggctcattgatgatgaatattcaagaattgggttcgatcaagcgtggaaatttaccaatcaaaattttattgcttgataaccaacgtttgggtatggtgcgacagtggcaatcgctcttttttcatggtcgccatagccacactgttttagatgataatcctgattttgttactcttgcttctgcctttggtattgcaggtgaacgaattgaaaaggcaagtgaagtttccgatgctttggatcgattattaaatgccaaagaagcttatttactacatgtctgtatcccagatgaagaaaatgtatggccacttgtaccgccaaatacatgtaacagtaatatgattgaagaagatattggggtgtaaacaatgaaaacttacgatttaactattcaagcaaacaaacgccctgaaactttggagcgtttgttaagagttgtccgccatcgtggttttgaagtcattattctacatagtgaaagtaaaggtaatgttattgatttgagacttactgtgcaaagtgagcgagctattgaattattgattcaccaattagtgaaattaccggatgttattacattaagctaaagagcggtctaaatttgtataaattattatacaaaatagatggttagtttaaagggagataagttgtggaaggtgctgttttagcgattaaattgggattggttgaagagattgtttttgaaaatggttcaaagatgtcaacggcaattcggaaaaaaccgatggaacaagctatcgttcatgaattaggtgcggaaggaaatgatgttggactgaaagcacatcatggaggcattgataaagcactgttttttatggctgaaagatcttttgctaaattaaccgctcttttgggtaagcatgatagctatcaaggagaagctatctatggtgaaaattttattgtttctttttttgatgaagaaaatgtatgtgtcggcgatcagtaccagatcggagatgtacaaattgaaatttcacaacctcgcataccttgtgaaacgttgtcaaaaaatgccaataataaaaatactcgagcgattgttgtagaaacagggctgaccggttggtatgtgagagtcattaaaaatggcgtgatcaaaaaaggggataaaatccggcgtttagctaacccttacccaaaattaaccattaaatatttaaattatttgctggcaacggaagcgactgtggagcttaaaactcaattagaacaagcaattgaatgtcctgttttggcggaggcttttaagcgttacttaaaaatgaaatggcgaaaaatcagttaaatatttggttaagtgagatattattaatcgacttatgtgaagaataaagaacgtgattaaatatttactgatataatggcgaaaatttttcagataattttaacaagcggtctctaattttgaatatttctttatttcgacaaattctctcctctacaaaatggcagaatgatatttttactttatctccgcaaaaacaagattggctattacatcaaggttcattaactcgaaaattacagcaatattgtcagcaactgaaagttgaaattgtggcggaaaaatgggtttctgacatgtcttttggatttaccggacatcatgagccaatttggttgcgtgaagtgatattaaaaggtgatgagcaagcttggatttttgcacaaactcgtttgccacaatctacgattgagaatgttgcacctgacattatcaatgtaggttcaacgcctattggcttatggcttttccctcaacaaccaaaaagaaaaacacttgaatggatatacgataccgcaacaggattatatgctcgtcgttcagtattgcttttaaatcaatatccaatcgaaattaaagaattgtttttgcaagattttaaattttttcaatcaaaggtctaaagcatgagaaccccgaaaaagacaaacaaaaaagcgaaaaaaatcaccgcacttacagaagatccgtattttttccaagagcaacagaaatattctaatccaatcccaagtcgagagtttattttacaaattattcgtgattttaatgcacctatgtcgaaagaaaatcttttcaagacattggctatcgttgatcctgaacaaaaagagggaatgcgtcgccgtttgcgtgcaatggaaaatgaagggcaattggtctttactaaaagaaagtgttacgccttgcctgaaaaattggatttattaaaggggtcagtgattggtcatcgtgaaggctatggttttttacaaatcgaaggaagcaagtcagattggtttattccaaatattcaaatgcaaaaagttatccatggtgattttgtattggcacaacctaatggctatgaccgtaaaggacgttcagaggtgcgtattgttcgagtgttagaaagtcgcaataaacatattgttgggcgttttttcatggaggaggggattggttatgtcgtgccggatgatagccgtattaatcgtgacattctgattccgaatgagtttcgcaacggagcgagaatgggacaggtagttgtggttgaacttaaacctcgtacagcaacatttacgcagttggttggaaaaattgtagaaattcttggggagaatatggcaaagggaatggaaactgaaattgctattcgcaatcatgatattcctcatatttttccaagtgcggtagaaaaacaagtaagaaaatatacggatagtgtgccagaggaagcaaaacaaggacgaagagatttaagaaccttaccattggtaaccattgatggtgaagatgcacgagattttgatgatgcggttttttgtcaaagaagtggtgatggcgggtggacattatgggttgccattgccgacgtgagctattacgtacgtttgcgtactgcattagataacgaagcatatcagcgtggcaattcggtttactttcctaaccgagttgtaccaatgttgccggagattttatcgaatggattatgttcgctcaatccacaagttgatcgtttgtgtatggtatgtgagatacgaatttcgccacagggaaaaatgactgattacagtttttatgaagcggtcatgaactcatatgcaagattaacttacactaaagttgcacaaattttggcaggtgatgaattattacaacaacgctatcatgttttagtaccgcacttacaagaattgcaccaaatgtatcaggctctgctgcaagctcgttatcagcgtggagccattgattttgaaactattgaaactaagtttgtcttcaatgaaatgggacgtattgaatgtattgaacctatggtgcgtaacgatgcccataaaatcattgaagaatgtatgattttagcaaatattgcagcagctaattttatggaacgtcatcaagaacccgctttattccgtattcatgccggaccaagtcaagaaaaactcagtgcatttcgtgcttttctacgtgaatgtggcttaacgttaaaaggtggtataaaccccacaaccgcagattacgcacagttgttagcccaagttcgtgaacgtccggatcatgaattaattcaaactatgctacttcgttcacttagccaagctgtttatcaccctgataatattggacattttggtttagcactaacggaatatgcacattttacctcgcctattcgccgttatcctgatttaacgttacatcgtagtatcaaatatttattagcaaaacagcaaggttctaaaagaaaaacaaccgataccggcggttatcattattccctggaagaaatggatcttctcggtgatcattgttctttaaccgaacgccgagctgatgatgcaacaagagaagtggtagattggctaaaatgcgaatatatgcaagatcatgttggagatgaatttgacggtattatttcttctgtaaccggttttgggttgtttgttcgtttagatgatttatttattgatgggctagttcatatttcaaccttagataatgattattatcaatttgactcaataaaacaacgtttaattggggaaaattccggtacgacctatcgtctcggtgataaagttaaaatccgtgttgaggcagtcagtttagctcaacgccaagtggattttgttttattatcgagtcagcgtaaacctggacgttccggcaaaacggcgaataagcgagcgaaacaaaaaagcttccaagaaaagaaccgcacttctaagatcgagcgacataaaagtgcggtaaaaataacaaaaaaattatcaaaaaaacaacaaagtccggcaagtaaaacaagaaaacagaaaaaacagaaaggataaaaaatcatggcagaaaatatttatggaattcatgcggtgcaggcttttcttattaatgcaccagaacgtttgatcgaagtttatgtgctaaaagggcgggaagataagcggttacaatccgtactgaatgagctttataaattaggtataagcgtacaatttttgaatcgtgatacattggataaaaaagcgaacggagaagtacatcaaggtatcattgctcgtgttcaaccagctaaagagttgaatgaaaatgacttggttgagatcttacaaaaaaaagcaaatccattattgctggtactggatggtatcacagatccacataatttaggtgcttgtttacgatcagcagatgctgccggtgtttgtgctgtgattgtaccaaaagataaatcagcacaattgactgcgattgcacgtaaagtagcttgtggggcggcggaggttgttcctcttgttcgtgtaacaaatttagcccgcactttacgagatctacagcaacaacataatatttgggttgtaggtacggctggcgaggcgattgaaactttatacgaagcgaaattaaccggcggtttagcacttgttatgggggctgagggagatggaatgcgtcgtttaacccgtgaaacttgcgatcaattgattagcattcccatggcgggttccgtctcttcattaaatgtttctgttgccacaggcgtttgtctatttgaaattgtgcgacaaagattagggtaatactttcttaatctaaaaaggttggatgtgatgtgaaatatgtttattatgtaaattaaaaggactgaaccctgcagaatacagagtgcagtccttgaattaaatcagtccaatcagatcatattgtcaggaaatttttgctattttatacccttcttatctagtttttcatacgtttgacagccaatgtttaagccattatcgcacgctaatctataatattgtttagctttagaaacatttctttgtacaccctgtccgtwtkcrtacatcamrccgagattgtrttgtgcatttgcatmtccctgttcagccagttgtttgaataagggaaaagcgtcagaataattttgttgtttaataaattgtaaagcacgattaaatctttcggtatctgtttcggcaagtgtagattggacaataccgaaagagagtagagcgataagtatggatttttttagattcatctgagctcctttgttgactgcttctcatggttcgtttaaaaaattagatatttaagttaattgcatcatcaataaagtattggtccatatcaaatgcaggtttcgcccctttatttttgcctactatttgagaaggcacaccagcgacagtagtgtattctgaaacggattgtaacactacggagtttgcaccaattttagcgtaacgcccaatttcgatatttcctaacactttagctccggacccaatcatcacaccttctcgaattttaggatgacgatcgccgctttctttacccgttccccctaaagttacaccttgcaaaatagatacatcattttcaatgacagatgtttctcctatcacaatacctgtggcatgatcgaacataatgccgcaaccgattcttgctgcgggatggatatctacatcaaaggcaacggatatttggttttgtaaatagatcgccaatgcttttcgtccttgttgccataaataatgggtaatacgataactttgcaatgcgtggaagcctttcaaataaagtaacggtgtagagtattgttctacggcaggatctcgatgacgcacggctcggatatcgcaagccgcactttcgataatttgcggttgattttgatgtgcttcttcaataatttctcgcaatgcaatagcgggcataattggattagctaatttgttcgcaagaatatagcttaatgcactgcctagattgttatgttttaagatagttgcatgaaagaaactggctagcattggttcattttcagcgagttttgctgcttcagcacgaataagactccatacttctattgacatgttactcccttttgcgttttcttcccaataaagtaatagccgcatcttcaggttttttaccacaaaatagtatttgatatacctgctcggtaatcggcatttctacaccctgttgctgggctaataaaaaggtttcttttgtattgtaaaaaccctctataaccggaccaagttcattgatagccgttgtacaatcaaaaccttgtcctaacattaatccaaaacgacggttacgagactggttatcggtacaagtaaggactaaatcccctaagccggatgttcccataaacgtattcggattcgcacctagagatatgcccaaacgactgatttcagcgattcctcgagtaattaatgctgtacgtgcattagcaccaaaccccataccatcagaaatccctgcagcaatagcaattacatttttaaccgcccctccaagttgtacaccaatcatatcttgattaacatagactcggaatttgctacaatgaattctttcttggaactctaaggcaaattgttcgttatttgaggctaatgtaatagctgtcggcatgccggcagccaattctttagcaaaggtaggtcctgataagactgctaaaggataaccatatcctacatgctcttcaacaacttcttgtaataagcgtcctgtatttcgctccagtcctttcgttgcccaagcgatacgttgatccgatcttaagtgcggtttaatttgcatgataacgtcgccaaaaacatgacttggtacaacaattaataactctctggagtgttgaatggcttgtgctaaattgtcttctacatataaagaatcaggaaagtgaatattaggtaaaaatgcttgattttttcgctcattacgtaagcgttgacaatgttgaggatgatgtccccataagtaggttggatagccattgcgagaaaaggcaatagctaaggcagttccataagcaccggcaccaattacggtgattggagttggagaaggactgttatcattcatattttttcttagaattttcggaattaatagaaatcttagggtgttattacaacaccctgagagattaatggacttctttcttttctttttcttcagcttttgactcctcttgtgtttgttgacgttgcatatactcaacaaataaggcatcaaaattgaccggtgctagatttaaagccgggaaagtgccacgattcactaaactggaaattaattctcgtgcataagggaataacatatttgggcattgagatgttaggcaatgtgctaattgtacatcttctaaaccgcttatagcaaagatgcctgcctgttttacttcacagataaaagcaacatcttcactgccttccattgtagtttcaacagagatattcaggcaaacttcataaagatcttctgctaaatgggttgtttctgtgcttaaattaaaatctagtttcggtttccattcttgttggaaaatgtgtggtagattaggtgcttcaaaagaaacatctttaacgtaaatacgttgaatttgtaaaacaacttctgttccttgttcttctgttactgcatcttgatttttttctgtcatttttcgatccttatttatgttttttgactaaaggtaaatttgccgcaatccagccactgataccatctttcagtgagtaaactcgactaaatccttgtttaactaataattctgctgatgcacctgcattcatacctgttgcacaaactaaaattacaggggtatctttatgttgttcaatttttcctaaattttgatttttaatctctgttggcaatacattgatactgttgataatatgaccacgttgaaattcatctattgtgcgtaaatcaataacaatagcctcttcattattaattaaacgagtcgcttcggcgttttctactgccgtaactttactggtaaatgattttaccgatgtataaattaacatgacaaatacggcaatccatgctattaccattaggctatgattttttgcaaactctgttgctaaagggagatattcttgcattttttctatttttcaaggttaaagttaaggttaaaaataaagggctaagtataaccgcactttcttcatctttcaaaatttttcaaagaaagtcctgcaaataaattgatctatattatagatagcctccctgtttattggtatattagccccaaatttcaaggaagtcttgataactttgttgaaatagggtttccgattttatcggaaacgatttttaagtagaaaaaataggaaaaaaaatgttttatattcaattcgctatcgttttagtgtgtattctgattggggcacgcattggtggtatcggtttgggcgttatgggtggtttagggctttgtattctcgccttcggcttcgggttacaacctgctggattaccgattgatgtgatgtttatgattatggctgtagtttctgccgctgctgcaatgcaggcagctggtggtttggattatatgatcaaaatcgcaaccaatattttacgcagaaatcctaaatatatcacttttgtcgcacctgccgtaacttggttatttactttcttagccggtactggccatgtagcttattctgtattaccagttatcgcagaagtaagtcgtcacagcggtattcgtcctgagcgtccactttcaatggcagtaattgcatcgcaatttgctattgtagcaagtcctatcgctgccgctgtagtggctgttgtgaactatttagaaccacaaggaatcaacttgggtagcgtcttaatggttactattccgtcaactattttaggcatagcacttgcttgtgtttttgtcaataaaatggggaaagaattaaaagacgatccgaactatcaacgtttattacaaaatcctgagtatgtcaaagaaaacagcgtaagtaatattgctgaaattgaaataaaaccgactgcgaaattatcagtgggcttattcttattcggtgcattacttgttgttgtgatgggagcgtatccagagttacgtccatcattcaacgataaacctatgggtatggctcacactattgagatcgttatgttaaccgttggtgcattgattatcttaacctgtaaaccgaatagtaacgcaattacacaaggttccgtattccatgctggtatgcgtgcggtgattgcaatttttggtattgcttggttgggagatacgttgatgcaaggtcatattgcaggcattaaagaaagtgtgaagttattagttgaaaccgcaccttgggcatttgcatttgcactgttcttactttctgttttggtaaacagtcaaggggcgactgtagcaactttatttccgctaggtattgcattaggtattgaacctgcgattttaatcggggtatttgtagcagtaaacggttatttctttattccaaactatggtccaattattgcttcaattgactttgatacaacaggcacaacaagaattggtaagtttatctttaatcacagctttatgcttccaggtttattaagtatggcatttagcttaggtttcgggttattgtttgcaagtattttactttagctttcactaaataatttataaaaacaccgcacttattttaagaagtgcggtgttttttgagattttgattttttaaataccgaataaaacagcaatgaaaacggtcaagccgaaataattgttatttaaaaaagcgttaaagcaactcgctctatctctatttttagtcaaacggcattggtaaacgaaaaataagccggcaatagccaatacaataaaatatctgttatttaattgtgataaataacccacggaaaagagaaaaatcagcgttattatttgtaataatgcaatgattttattgtcatattgagcaaataaaatcgccgttgatttcactccaatacgcaaatcatcatcacgatctaccatggcatattgagtatcatatgcgactgtccaagataaatttgcaataaataataaccagcattctagaggcaatgcttcaatagtcgcaccataagccattggaatagaccagccaaaagccgctcctaagaaaaattgtggcaaatgtgtataacgtttcataaagggataaataaatgccaaaatgactgcaatcacagataaaccaatagtataaaggtttaaacaaaggactaataaaaaagaacaaaaaacgaggacgataaataaccattttgcttcacgaggtgttgctcgacctgttgaaagtgggcgtagtgaagttcgtttaacttttccgtcaatatggcgatctgcataatcattgatgacacaacctgctgaacgcattaaaaatacgccgcatataaaaattgctaaaactgatagggtaggcatcgctttttcggcaagatataatgcccaaagcgttggccaaagtaaaagcaatgtgccgataggtttgtctaaacgcattaattgtccataagcaatcagcttatcttttgcaggtattgtcatttgattggctaaaccttgtaattcttaataaaagtgcggtgtattttactgtaaaatcctttttggaaaaagtgagtttaccctataaagaaacagtgttatattgcgaaatacttttattgttaaactatcataaaatgactacattcaaagaaatcaactctgaacaagcatgggaaatattaaataataagaatgctgtattagtagacattcgtgatttatcccattttatttacagtcgtccgcaaagtgcttttcatttaactcatcagcgttttagtgaattccaacagaaatatgaatacgaccaaccgattattgtgagttgttatcatggtgtgagtagccgcaatgtggcacaatttttagttgagcaaggctatgatgaagtttatagcttaattggaggtttcgccggttgggtacaagcgaatttaccggtggaaagtggatattaaataaaaggcagatcatttctgccttagttcagtccaaccgcacaaacatagatcaaaacactataaaaaatcaccgcacttagtagcaaaacatattttgccagcttactgttacgttgatttaatttaaatgaataacgagcaataatgcctaaaataaaaggataagcccaaaagaaaattgacatccatctcatttgaaaatcatccaaatttggatttttaatgaaattaggtgagattaagagagctaatggccaaagcaaaacaggtaggcaaaacccaacgagtgcccaagaaaatttactaaatccggttggcatgttttgttttttcatttttatcctcgataatatatacaagagaacaggaatatagcaaatgaaactattatttggtagtgaaagagagaattttattatttggtttcgtgattatatccgagctaagtatttgcttgaattgaccattcaaaactatattgatgaaaaatacaatcggtcggtgcgtggtgtttttatagaagaaaatcatccattattgacacagcttgaacaagagaaaatactttttttgcaggatccttttaacccttgttatcagcaggcagcttgggaggccggcgatacacattccattcagtacaaaaaaacatcatgggtggctatttggaaaatctcatcgaaatggttccaacaaggtaaaataactttatttattaccgcactttgcactctaatttacgttttacagaacttgggatttgagcaaggtattttctattttgctcattatccagcaaatccggcacaacaaacagaaatttggcgttatatttcgcatagtttagtgcatctctcgccactacattttttatttaatctaagttggttttggttatttggcggggcaattgaacgacagctgaatgcaaaaaaattactgttgctcttttttgtttcatctattttgaccggagtcgtgcaaaattatttctctgattatcgtttcttcgggttatctggtgtagtttatgcggtattgggttatgtatttattttagataaatttcattatgctaaatttgctttaccatcaggttttttcttgatgttaattatggggatcgccttaggttttattagtccgcttgtaggtatttatatgggcaacagtgctcatattagtggtttattatgtgggattttattaggcttatggcaagttaaaaaaagggagttttgagaactaaacgtaacatattgaaatcaatgaaatgtgtattgtcttatttctatgctctttcaaactcaagataaaatagatcgaaatttggaggatagagataaacgctgtcttgaagagaaatttattttgccattatggttattcttaattttcgcataaaatttgataatttcctttgactaattgacaatcaaaaggtaatattcacgccctatgcaaaaggtaaaactacccctaactgttgacccgattaaagatgcacagcgtagattggattatcaaggttgttatgtgtccaatcaagttactcgtttagcggagtcagtagtcaaagtgctcagcgatgtgcaggtaacattatcgtttttcgttgatccgcaaaaattgactgtaatgaaaggaagagcgagtgttgatgtggaattagaatgtcaacgttgtggttgtcctttcagtcaatcattggaatgtgagttttcttatagtccagtgtctgatttgggtaagatcaatgaattgccagagatttatgaaccgatagaattaaatgaattcggggaaatagatttaattggaacggttgaagatgaactgattgttgctcttccaattgttccgatgcattcatctgaacactgtgaagtgtccgtggctgaacaggtttttggcgaattgccggaagagctggcaaaaaaaccgaacccgttcgctgtattagctagtttaaagaaaaagtaaatttaggagtatagccaatggctgttcaacaaaataaaaaatctcgttcacgtcgtgatatgcgtcgttcacatgatgcgttaaccactgcagctgtatcggttgacaaaacaagcggagaaactcatttacgccaccatgtaaccgcagatggttattatcgtggtcgtaaagtgatcaataaataatcgttgattgtttaaggtaatcacttgagtcatctaactgttgtgttagatatgatgggcggggacatgagtccccgtattactatctgcgaattggtaaaagcgttgggcaggtatccaatgctgtctttgttgtttgctaataaccaacaaatttttcctctacgtcaacgttttccaatcggtagtcaaaattatttagccgtctgtcattgctctcatgtgattgaaaataatcagtgtttagttcataccttagttcatatttttgtagaataccagctaggtttattttatctatatgcagctttgttaaatataggtattgaggaaactaaagaatataaagaatataaagctattcgagatatggcattataatcttcaaagaaaggttaaagaaaatcttgccggtttgaataaaattaagacgtaacttgatgagataattatgtacagtagaattttagcaaccggtagttatataccggctaatatcaggactaatgctgatttagaaaaaatggtagagacatctgatgaatggattactactcgttccggtataaaagagcgtcgtatcgccggtgaaaatgaaacagttgccacaatgggatttgaggccgctaaaaatgcacttcagttagccaatatttgccctaacgatatcgatttggttttggttgcgactactagccactcctatgcttatccaagtgctgcatgccaaattcaaggtatgttggacattgatgatgcaatttctttcgatttggcggcagcttgcacggggtttatctatgctttaagtgttgcagatcaattcattaaaacaggtaaagtaaaaaaagctttagtgattggtgcagatattaattctcgtaagttagatgaaacggatcgtagcactgttattttatttggtgacggtgctggtgccgtgatcttggaaagcagcgatattgaagggattatttctactcatttacatgcttctttagataaaagtaacgccttaattcttcctcaaactcaacatggtgaagcacaatccggttatattcaaatgcaagggaatgcaacttttaaacttgcagtacgagaattatctaatgtagtagaagaaactttacgtgataatcacttagacaaagctgatttagattggttggtacctcatcaagcaaacttacgtattatcacggcaactgctgaaaaattgaatatgtctttagatcaagtggtaattactttagacaagtacggtaatacaagtgcggcgacagtacctgtggcattggatgaagctatacgtgacgggcgtattaagcgtggtcaattattattattagaagcatttggtggcggttggacttggggttctgcgttggttcgtttctaaattttaacaaaaattgaatatacttatttagtaggaaataaaaatgaaaaaatttgcaatggttttccctggacaaggctcacaatcagtgggaatgctggctgaattggctgcagaatatccgattgttgaagaaacttttcagcaagcttcttccgttttgggttatgatttatggcagttagtgcaacaaggtcctgcagaagaattgaataaaacgtggcaaacacaacccgcacttttagctgcttccgtggcaatttatcgtgtatggcaacaaaaatatcctcacctaaaacctgaagtgatggcaggacatagtttaggtgaatattccgctctagtatgtgccggtgtaattgatttccaagatggaattaaattggtacaacttcgtggcaagttaatgcaacaagcagttccggaaggaacaggtgccatgtacgcaattataggtttagataatgaaagcattgttcaagcttgcaaagcgtctgaacaaggtgagattgtgtcagcggtaaactttaattcaccgggacaagtggtgattgcaggagcaaaagtcgcagtagaacgtgcagctgttgcttgtaaagaggcgggagcaaaacgtgcgttgccgttagcagtcagtgtgccttctcactgtgcattaatgaaaccagcagcagaagaattggcagtagcgttagaaaaaatgacgtttagcatcccacaaattccggttattaataatgttgatgtgaaagcagaaaatgaaaccactaagattcgtaccgcacttgtgcgtcagctttatagtcctgtacgttggactgaaatagttgagaatatggcaagagagggaattgaacttttatttgagatgggacctaataaggtgctcactggattaactagtcgtattgttaaagagttgaatgctaaagcagtcaatgatttatcttcattgaatacagtggaagaaagcttagattaatttatgacaacagaggctgatactaaacagcctattttattgaggagtagatgatgcaaggaaaaatagcattagtaacaggtgctacacgtgggattggacgtgcaatagcagaagaattagcgagcaagggggcttttgttattggtactgcaacaagcgaaaaaggagcggaaagtatttctgcttatttaggcaaacagggtaaaggtttggtattaaatgtcgcagatcaagattcaatagatgctgtattgagtgccattaaagctgaagtgggtgatgttgagattctagtgaataatgcaggaattacccgtgatggtttattaatgcgtatgaaagatgatgactggtttgatattatgcaaactaatttaacgtctatctatcgtttatctaaagctgtattacgtccgatgatgaaaaaaggtggacgcattattaatattggttcagtagttggctcaatgggaaatcccggtcaaactaactattgtgcggcaaaagcgggtgttattggctttacaaaatcgttagcaaaagaagttgcagcaagaggagtaactgtgaatgttgtagctccaggtttcattgcaacagatatgacggatgtgttaactgacgagcaaaaagcaaatattctgacaaatgtgccgacaggtcgtttgggacagccaaaagatattgcgaaagctgttgcatttttggcatcggaggacgcgtcatatattacaggtactacattacatgttaacggtggaatgtatttaccttagtagaaagagggatttcaggctagccaaagataaggcgtaatgttaaaatcctgacatgtggtaatgtagctattgaaacaatcgagttacgttggctgttgcattctacaggttaacataacgtatttatgtttgtgtactgagacaggtatcattgtggtttgaccttgtaaaagtaaaaacagcttgaaacttcataaaaaatacatacactattatatcttatcgctaaccattaataggaaaaaagcaaaatgagcattgaagaacgtgtaaaaaaaatcattgttgaacaattaggtgttaaagaagatgatgttaagcctgaagcttcatttattgaagatttaggtgcagattctttggatacagttgaattagtaatggccttagaggaagaatttgatattgaaattccggatgaagaagctgagaaaattacaacagttcaatcagcaattgattatgttcaaaataatcaatagtaatgatacttgaaaattacacatgaaatcagtataatccgtattcacttatgaccctttgacagggtcatatttttgtgtggcacattgtgcttgtatgaaatggggagctgaaacggcgttattacccgcaaagaggaaattaaaaatggcaaaaaaagtccaagcatacgttaagttgcaagtcgcagcaggtatggctaacccatcaccacctgttggtccagcattaggtcaacaaggtgtgaacatcatggaattctgtaaagcatttaatgctcgtactgagagtctagagaaaggtttaccgattcctgtcgttattactgtttatgcagaccgctcttttacatttgtgactaaaactccgccggcagcggtattattgaaaaaagctgctggaattaaatctggttctagtaaacctaataaagataaagtaggtaaagttactttagatcaaatccgtcaaattgctgaaactaaagcagccgatatgaccggtgcaacaattgaaactaaaatgaaatctattgaaggtacagcacgttcaatgggtttagtagtggagggttaatctaatggctaaacttactaagcgtatgaaagcaatcaaagccggtgttgattcaacaaaacaatatgaaatcaatgaagctattacggtgttgaaacaattcacttcaacaaaattcgttgaaagcgttgacgttgcagtcaatttaggtattgatgcacgtaaatcagatcaaaatgtacgtggtgcaaccgtgttaccacatggtacaggtcgttcagtacgtgttgctgtgtttactcaaggtgctaatgttgatgcggctaaagcagctggtgctgatttagtaggaatggaagatttagcagagcaaatcaaaaagggtgaaatgaactttgatgttgttattgcttcccctgatgcaatgcgtgttgttggtcaactaggtcaaattttagggcctagaggcttaatgccaaatcctaaagttggtaccgttacaccaaacgttgctgaagcggttaaaaatgctaagtccggtcaaatccgttaccgcaatgataaaaacggtattattcatactacaatcggtaaagcaaatttctctgctgaacaattaaaagaaaacttgcaagcattattagctgccttgactaaggcgaagcctgcgacagcaaaaggtatctttattagaaaagtaagtgtttctactactcaaggtgcgggcgttgctgttgatcaaagtagcttataattaatatagccaaacctttacagaggcgtattttgtatatataatgcacgcctctattttgccttatggcataatttctggttggtgcttgacctctcaagccccgtccaagaccgtaggggaaagaatatttcttaataatcctacgtagatggtgatacagaataagaatttttcttgcttctgtgcaccttagcctcagagaagactgcaaaagtgcggtgtttttttgagaagttttataattccgatcaatcggagtgtattcaggagctaaaagccaatggcattaaatcttcaagacaaacaagcaattgttgctgaagtaaatgaagcagccaaaggtgccctatcggcagttattgcggattctcgtggtgttactgttgataaaatgactgagttacgtaaagcagctcgtgaagctggcgtttctatgcgtgttgtacgtaatactttattacgtcgtgcagtagaaggcacagattttgagtgcttaacagatacgtttgtaggtccaacacttatcgcattttctaatgagcatccaggtgcggctgcacgtttgttcaaggattttgctaaagctaacgataagtttgaaattaaaggtgcagcctttgaaggtaagatccaaaatgttgagttcttagcaacattaccgacttacgaagaagcaattgcacgtttaatgggtactatgaaagaagcagcggcaggcaaacttgctcgcactcttgcggcataccgcgacaaattacaagaagcggcttaattaaagcctttcttaactcgtttaatttatttactttaggaattgattgttatgtcattaactaacgaacaaatcattgaagcgattgcttcaaaaactgtcactgaaatcgtagaattaatttctgcaatggaagaaaaatttggtgtttctgctgcggcagcagcggtagcagtagctgctggtccagctgaagtagctgaagaaaaaaccgaattcgatgtggttttagctgaagctggtgctaataaagtagctgtaattaaagcagtacgtggtgcgactggtttaggcttaaaagaagctaaagacctagtagaatctgctccggctaacttaaaagaaggtatttctaaagcagaagctgaagcacttaagaaagaattagaagaagctggtgcgaaagtagaaatcaaataattttgattttttcaatcttctagttcagaaaagacttggtggacaccccaaggtcagaataataatcctaccttttcgtgcgttttcgaaggtgggattattcttttttatgctgtcgaagagtttatttgtagatgatcgtaatttgggagaaaaactttacttttgtctgcagtgggttgagtgcggtttgttttaagccgcactttttcgtttcattcgcaatgagattttttattttaagaacgtttcataacttcaaaaaattcttcattggtttttgccatcattagcttatcaattaagaattccattgcctcaatttcacccattggattaagaattttacgtagaatccacattttttgtaattcatctggtgtagtcagaagatcttctttccttgtaccagaacgattgaagtcaatagcaggaaatacacgtttttctgcgattttacgggaaagatgcaactccatattcccagttcctttaaattcttcaaaaatcacttcgtccatttttgatccggtatccacaagtgcggtggcaataatggttaaactaccgccttcctcaacattacgggccgcaccaaagaagcgttttgggcgatgcaatgcattggcatctacacctcctgataagatttttccggaagccggtgttaccgtattataagcacgagctaagcgagttatgctatctaataaaataaccacatcttttttatgttcaacggaacgttttgctttttcaatcaccatttctgcaacttgaacatggcgtgctgccggttcatcaaaggttgaagcaatgacttcgccttttactgagcgttgcatttctgttacttcttccggacgttcatcaatcaacaatacaattaactcacattccggatagttatgaataatactttgtgcaatattttgtaacaacatggttttacctgcttttggcggagcgacaattaaaccacgttgtcctttaccgataggggaggctaaatctaaaatacgagcagtcaaatcttccgttgaaccatttccacgctccattctgaggcgtgaatttgcgtgtagtggagttaagttttcaaagagaattttactacgtgatacttctggtttatcgtcattgactcgatcaacttttagcaaggcaaagtaacgctctccttcttttggcggacgaatttttccttcaattttgtcgcccgtttgcaggttgaaacgacgaatctgacttggagaaacatatatgtcatcaggaccggctaagtaagaactatcggcagaacgtaagaaaccgaaaccatcaggtaaaatttctaatatacctcctccaaaaatgtcctctccacttttcgcatgttgttttaaaattgcaaaaataatgtcttgtttgcgtaaacgagctaaattttctaagcccatttgtttttcacctaattctacaagttcagaaacaggtttatttttaagttctgttaaatgcataataaataattgagaatgttataaaaatgaattgataaatgaattgaatgtaaatatgaaattgcgtgcaaatttatcattaaatctttaagttgtctagctatctaacttaaaaatcaataaatgtgcggacattttttgaggattttttccgttcatgttattatcacccaaattctttactgataatttttatgcaaaatagtcatctttcacaacaacgtttttctgatcttgctttacattgtagcgtgcaacaagcgataaaagaaaaaggctttgagttttgtacacctattcaggcattgtctttacctatcaccttaaaagggcaagacatagctgggcaggctcaaaccggcacaggaaaaacgatcgcatttttaaccgctacatttcatcatttactacaaaaaaacaatataaattcctcagaacaaccgagagcgttaattttggcaccgactagagaattggttgtacaaattgcaaatgatgcgaattttctggttcaagcaacagggttgaaaactggcttagcttatggtggtgagggctatgataaacaattaaaggtaattgatcggggtattgatattttaattggcactacagggcgtgtaattgattatgttaagcaaggaattattcgtttagattatattcaagtggtagtgttagatgaagcagatcgaatgtttgatttaggttttattagagatattcgttatttattacgtaaatgtccagtgcctcaacaacgtttaaccatgcttttttctgcaactttgtcttataaggttcgtgaacttgcttttgagcatatgaatgatccacagtatgtagaaattgaacccttacaaaaaacggggcatagaattagagaggagttattttacccttctaatcaagataaaatggcattgttgatgactttattagaagaagaatggccagagcgttgcattattttttctaatactaaacatcgttgtgaggaaatatggggatatttaagtgcggatggtcatcgagtaggattattgaccggtgatgtaatgcagaaaaaacgcttatctttactcaaacaatttacggatggaaccttagatattttggtggcgacagatgtggcagcacgagggttacatattccggatgtgactcatgtgtttaattatgatttacctgatgattgtgaggattatgtacatcgtattggaagaacagggcgagcgggtgaaagcggtatttcaatcagttttgcttgtgaagaatatgcgattaatctgcctgcaattgaagaatatattggtcacagtattcctgtcagtcaatatgatgcgaaagcattgatcgaagatttgccaacacctcatcggattaaacgaggtgcatttgatagccgttcaaatttacaacgtactgtaaagagattgaaaaaaacttattaatttaaccgctcttttatgggatctttgccaagataagcaaatatccctttaattaccggacgataacgttgtacactaatacggaattttcgactaggaaaagagagataaaaatgacaccttatttaattgctccatctatactttctgctaatttagcacgtcttggtgaagatgtagaaaatgtgctaaagagcggtgctgatgtaattcattttgatgtgatggataatcattatgtaccaaatttaacctttgggcctgcgatttgtaaggcattgcgtgattatggaattaaagcacctattgatgtacatttaatggttaaaccggtagatcgtattattcctgattttgctaaagccggtgctgattatattacatttcacccggaagccagtgaacatatcgatcgttctttgcaactgattcgggattgtggttgtaaggctggtcttgtttttaatccagcaacaccattgagttatttagattatgtattggataagattgatgtgattttgcttatgtctgtgaatcccggatttgggggacaagcttttattccaagcacattagaaaagttaaaacaggctcgtaaaattattgatgaaagtggcttggatattcgcttagaggtagacggtggagtaaaagtgaataatattgctgaaattgctcaagctggagccgatatgtttgtggcaggatctgcaatttttgatcagcctgattataaaaaagttattgatgaaatgcgtcagcaactttctacaataagagagaaggaaacaaaatgacacaatttaaattaattggttttgatttagatggtaccttagtaaacagtttgcctgatttagctttatcaattaactctgctttgaaagacgttaatttgccacaagcatcggaaaacttggtgatgacttggattggcaatggtgctgatgttttgagtcaacgtgcagtggattgggcttgtacacaagctgaaaaagagttaacggaagatgagtttaaatattttaaacgtcaatttggcttttattatggcgaaaatctttgtaatatcagtcgattatatccaaatgtgaaagaaaccttagaagcattaaaagcacaaggctacattttagcagtcgtgacgaataaaccaactaaacatgttcagcctattttaactgcttttgggatcgatcatttgtttagtgaaatgctggggggacaatctttaccggaaattaagcctcatccggcacctttctattatttatgtggcaagtttggtctgtatccgaaacaaattctttttgttggcgattcgcaaaatgatatttttgctgctcattctgcgggttgtgctgtggttgggttaacttatggttataactataatattccaattgcacaatcaaaacctgattggatctttgatgattttgctgatattttaaaaattacacaataaggataaaaaatgacaaaaccggttgtattaagtggtgttcagccctcaggtgaattaactattggtaactatttgggtgcgttgcgtcaatgggtaaacatgcaagatgagtatgagtgtttatattgtattgtagatttacatgcaattacagttcgccaagatccggacactttacgtaaagcaacgttagatgtattggctctttatttagcctgtggtattgatccggagaaaagtacgatttttattcaatctcatatacctgaacatacccaattggcatggattttaaattgctacacttactttggtgaaatgagccgaatgactcaatttaaggataaatcagcacgtcatgctgacaatatcaatgtaggtttatttacctatcctgttttaatggcggcagatattttactttatcaagcaaatcaagtacctgttggtgaagatcaacgtcaacatttagaaattacacgtgatattgcacaacgttttaatgctctttatggggaacattttattgtgccagaagcatttattccaaaagcaggtgcacgagtaatgtccttgttggaacctgagaagaaaatgtctaaatcggatgaaaatcgtaataatgtcattggtttgttagaagatcccaaagcagttgtgaagaaaattaagcgagctgtaacagactcagatgaaccgcctgttgtgcgttatgatgtaaaaaataaagcaggtgtatctaatttattagatattttatccggtgtaacaggaaaatctattgtccaattggaagctgaatttgaagggaaaatgtacggacacttgaaaagtgcggtggcagatgaggttgctactatgctgactacattacaagaacgtttctatcatttccgtaacaatgaagaattattaaataaaattgcggctgaaggtgcagaaaaagcccgtaagcgtgcaaaggaaaccttagataaagtttatcgtgcaatgggttttgttactccataaaaacgatttttcccctaagtatttaggggatctttattcttattgtaatacattttcgaaaaaaacagtatttgcagtagggtcacttaatgaaaatagtaagaactttccgaaaaaccgctgttattacaaacctcagaaatctgatacttcgtatagaataagagaaaaatcttctatggcaaaaaatagaaaagcaagcatttcccatgtgacattattagggtgttaaaatccaaggttgtgctaatgaaagagaataaatattagcgatgaaatgagattgttcttctttgggaacggggaagggaataaaggttaatagttcttggtgtaatttcaaaatttttgtaaaacagaccgctctttcgatctctgaaaaaaaatctgggtttaatgctttagccacatatcctctttttattctgcctagtgccatagctaaatgaatgagtaacatgtctacttgtttcgtttttaaatttactcgccattttttaccaagacgatttcggatattaagagtaattgtcataatatcttcatcaattaaatggcgttgaactaaaaaaatcagcctttgctgtattaacatgaatttcattccattacgaaaaggatagtttactttacctgaaataaacacaattaagtagtgcatagatcacaactttgtaggaaaataaacaaaattttacacgataggaattaagatgttaaacaaggaaattatcgcacgatatgaaggattaatttttgatatggatggcacagtaattgatactatgccttgtcataaacaagcttgggagcttgttggtgctgaaatgggctatgctttggatggagatgttatgtatcaattggggggagctccggtaagaactattgccaaagccataatggaaaaagcacaaatgccgttatatttaatggaagatgtgattagtttaaagcgtaaatatggaattgaattaatcatgaaaaatgctactttattgcctgctgcggatattgtgaaacaatatgttggacaaaagcctttagctctcggtacaggttcacatcgttacgtcacggaaatgcttttagagaaatttcaattgcagtcttattttggtgctattgtgacagcggaagacgtgattaatcacaaacctgagccggatacatttttgcgttgtgcagaattattaaatcttgatccgttaaaatgccttgtatttgaagatgcggatttgggcgtacaagccggattagcggcggaaatggatgtttttgacgttcgtgtaaatcaaataattacaagcaagtgattagattttatctgtattttgtgtaatctaaacatttaggcagagtagagaaatagttgccaaccttatttttgattatgtttgtagcttttatttaaaaaatactttataaacataaagttgtgcttttttaatccgttatgattatttcacgtttgctttaactctttaaaaagacccttggttctatttattgtcctttcaatatctaactcagaatatttctcgaaagtaaatagataattgtgatattgctttaaactagtataagctacttttattggcaaaacagttgtttattcatttttcaaaaataaagcttaaagccttgtgctataaggctttaagctggtttttagacaactattttgtctgctttagaatttataatttacatttaaaacaaatgtgcgtccttttgaatagttgtttaaggctttctggtatccatcgcccacgcccatagcataagtcatttggtttgccgagtcgttattcgcatctagcggattaatgtattttttatcaaaggcgttttgaatttcgcctttaatagttaagttttccgttggttggtagatagcgtaaaaatcgaaaattattggctgtgctttgatttcttccgtgccgctaattcttacataagtaagaaatgtctcgccagtctttctagaagtaaaagttcccggcaagataacatcgccatctgctttatcaagtctggctcgtttgcttttaccatagtatttagcagtaccgcctaatgttaattttccgtcaaataaacgtgttcctaggtcaagggaaccgtaatctttcggtagagacgatattttacttaagccgaacccttgtaaatattgtccggtttcactatcatcactcacattataacttgaatcagaaaatgaacttggttgattggttttttgtctggcataagataagttggcatagaaccaaccgatatcataatttaattcaagttccaacccctgaattttaacaataggtgatgaatcagcaggaatgagttggtttgaaggaacttttgtttttccatctcctgtatccaccaagtctgttttcaagattgttttaccgccttcatagttaatatgcgtaagatgttcaacgcagtcataaatagtcggtgctttgtttgatcctctccacgcgtttgaactacattcttgtttgatattgataatataatctctgattttcgtttgatacgctaaaatcttaaagcctagtgcatcaaaatccgagaatatcccatttttataaccgttaatgccgaattgaatggttttggctttttctgattttaaatcgggtcttatggctaatgtaccaaattcggagaaatacatctctttgatattcgggacccgatgggttttggcataactcacaaatggcgaaaagagcgggtgaaaatccgccgagaaagacatagaataattatcatgagatcttgaatctcccttgtggacagagtaaaaacttgggcagttataaacatcccaagtggtatcatcatcattaggaccagtataacaccccaatttttctgctccctcaacaccatacttcgcaactatctctgatgagttggaattgacccaaattggctttccattcttcatttttttatgagagtcatgccatgttctagatgaaaatctatctttaggatcaagagggaaaatcctaccttcgtatttatagatttggcgattggcattgacttttaaggtataaatatcgtatttaaaggtttggtcaaaatagagggttttaaaacgttgttcgccgtcgggttggaatgtattcgatcttatgccgtgatatttacatgcgtttttatacttaccaacctcatcacaagcatcaagtgaattaggttccccaccatcaaaataataacctaattcacgaggatgtcgatttttactgtatttatttttgaggatattggcacctaatgttgcttcataagagaatttttctgtgaatggaatagaaaaatgcatatttatatccgtggttttcgcactatttttgctttccaacacatctttcagcattttaccattaaacacgcttcccttgtgataggtttgcgtagaggtattatccgccaagattaattcaaattgtaaattctctttcggttttagttggtagtttaactggtagtttttattctctaaatttctgccggaaagtgcggtcgataaagagcggtatgataggatagctttattatatttatcgttatattcgattttggctaaatggctttggggatagtggagtaatttgcttgggtcatagggttgtaatccatagagttttcgtttttcatttctgtcacaaaatgcttcgcctttacaggcttcttcaactattcttcccacttcttcagcgtcaacatcttttatacttctacccccccccactttaaaatcttgcgagcttttacgccaactataggcatacataaaacctaatgttcttgtatcggaaaaaggatagcgaaaggcaactgcacccatataattcggtccggttgcattggttcctccgccaacatttaataaagcacctacatttctgccttcacttattacgtcatcaacaccgattgttctaaaatttgccgaacctactagagcattagcccccgctttaccgtcaaaacttcctcgttgaatatctacactggtaataaacgcagggtcaatggttgcaccgaattgagaggttccaccggctttttcgctgttatctcctgatgtggcaaaaaaggtttgggaaataccgtccaccatcgtattcacccgtccaaatcccgtttgaccacgaacgttcaccgacactgtccccgaacttttatcaaggttggtaaacgcacccggtaccgttctgatgatgtcatcaatagactgcgttgacgtggaaatattttctctcacactggtcgcccccgcttttttaaagacttcctgtttaggtggtagcttatattctacgttaatttgatcgagcatttcttctgcataaacacacgtgcttaatacggaaaaagctaccgcagtgagtttaaatttattagtcatcatttttatcctagttatttatgattaaattcatggtgtaaacatgtacgaccagttatataaaaatatcctgtgcatgtcaattaatgataataatttttattattatttttagtttatgcggaaattcagcatgttatcaaaattgatattcgccagcctgaaagctagagtttggctctggcggaaaacatgctttagttaaaaatgattcggaggaaatgcggtctattttttacaaagatttatctttaataaaaggaaactgaatgcgatattttatcgccagcattctgatgagtgtacaggttataattgccagccatggacttagtaggggagaaattaagcctgtcgaacctaatagttctatggttgcaccgacaatggctgcacctgcatatatttcagattgaaaaattaacggcgatttgtttgtcaatacatctcggatacagccaccacccaccgcactaatacaacccaaaataatagataattggatattttccgtcatataccacgttttattcgccccgaacgctgcaaaaaaacctaatccaacggcatcaagtaagttgctcacctttgagaacgacgttattttttcttgaaaaaaagatacgcaacacacggctaaaaggataattaatagataggcgatattttccaagcctgccggcggtgttgctgataggcataaatctcgaataattccaccgcctatcgctgttactgctgagacaacaaaaacaccaaataaatcaaattgtttcttcacgccagcaaccgcaccacttaaggcaaagataaatgtaccgagaagatcaatgaaattaaatacggataacataaaataccttaatcttaattttaaagcatcattctagcataacgaaattaaaaaaaaacttcgcagatgtaatggacacaaaaggattctatccattaatgaagcaaagtgtacatttgtacattacatcagcatagttgttatggtaatctagaagaacaaagtgtgttgaaaaaagagattcttggcgtaatgccgattttaatatttaaacgaaatatcctaagttatggtgaagaatatgataagtaatttaaccgaacagccttctggtgctgagtaccttaaagcaattttaagttcaaaaatttacgaacttgcacaggttacacccttacaacctatgctcaaactttctgagcgtttaagtaataccgttttagttaaacgtgaagatcgccaattagttcatagctttaaattgcgtggtgcttatgccatgattgccggtcttagccaaccgcaaaaaaatgccggtgtgattaccgcttccgcaggaaatcatgctcaaggtgtcgcactgtcagcgaaaaatctgggattaaacgcattgattgttatgccgcaaaataccccccgcattaaagtagatgcagtgcgtggttatggtggcgaagtgcttttatatggtgcaaactttgatgaggcaaaagcaaaagcgatagagctttctgaaagtaaaagtatgacatttattccgccttttgatcacccggcagttattgcaggtcaaggttctttagccatggaattattgcagcaaaacagtcatattgatcgtatttttgttcctgttggcggcggcggattagcagctggcgtggctgttttaattaaacaattaatgcctgacattaaagtgattgcggtagaaagtaaagattcagcttgtttacacgccgctttgaaagttggtcaaccggtagatttagagcgtgtcgggttgtttgctgacggtgtggcggtaaaacgtatcggtaatgaaactttccgtgtatgtcaacaatatattgatgatgttgtacttgttgacagcgatgaagtgtgtgcggcaatgaaagatatgtttgaaaatgtgcgtgctattgcagagccatccggtgccgtatcattagccggcttaaaaaaatatgtgaaagaacataatattcaaggtgaaacgttggttaatattttgtccggtgcaaatttaaattttcatacattgcgttatgtgtcagaacgctgtgaaatcggtgaaaaacacgaagcaatttttgctgtaactatccctgaagaaaaaggtagtttcctacgtttttgccatctgttaggtgatcgtcctgttaccgaatttaactatcgttatgctgataaagaacaagcctgtatttttgttggggttcgtattagtagtgaaaaagaaaaattagaaattattcaacaacttgaacaaaatgattataaagttatggatctctctgatgatgaaatagcgaaaacccatattcgctatatgattggaggacgaacaaccagcaatagcaaagagcggttatatagcttcgagtttcccgagcaaaaaggcgcattattaaaattcttgatgatgttaggtacgcattggaatatttctcttttccattatcgtgcttatggtgcagactatggtaacgttttggcaggctttcagttagatgaacatgatgaaattcggttcaatggtcatttagaagaacttgcttatacttatcaagatgtaacggacagccccgcttacaaatatttcttagcttgatgcacgataaaatcaaaaaatgccatactgaatggcattttttctactcaacttctttaattcgcaactctttcggcacttcaaaaacggtattttcttcgcaaccttcaagttcttccactttatcaacacctaattcttttaaacgggaaatcaccgattgaaccaatatttccggagctgaagcaccagctgttaaaccaataactgtaacattatccaaccaacttacctcaatatcatttgcatcatcaattaatttcgccgtaacacccattcttgaggcaagttcagccagtcgattggaattagatgagtttttagaacctaccacaataactaaatcggacagtttggctaattcacgaactgcttgttgtcgattggttgttgcatagcaaatatcatttttgcgaggaccttgaatggcgggatatttttgttttagcacctcaattacaccggcagtatcatcaattgataatgtggtttgtgtcataaacgtgatgtcttcatcattccgtaaagtcagtttggcaatatcttccacatcttctactaaataaataccgcccttatcgttatcatattgtcccattgtgccaatcacttcggggtgtccttcatgcccaatgagaatggcttttgttcctttacgactggcacgagcaacctgcatatgcacttttgtaaccaaaggacaagtggcatcaaatacttttaaattccgctctttagcctcttgacgaacagcttgcgaaacaccgtgtgcagaaaaaattacaatagcaccattaggtacttcatctaattcttccacaaaaattgccccacgctcacgcaatccattcacaacaaaacgattatgtacaacctcatgacgcacataaataggtgcaccgtgaatttctaatgcaagctccacgatactaatagctcgatcaacaccggcacaaaagcctctgggattagccaaaataattttcattagttttgcttactctcttttttatcgttttgcttaaaagcatcaatagccaataatccggcaccgatacaaattgcaatgtcggctacattaaacacagggtaatgccattgttgccaataaaaatcaaaaaaatccactacaaagccatgataagctctatccgccgcgtttgccaaagctccaccaatcattaacgcatagcctgtattttgtagtttctgtgttgcttgatttttatataagaaaaataaaatcatgaaggaaaccgctaaagccaataaaataaaaaagtatttttgccaacctgcatggtcagccaaaaagctaaatgccgccccgtgattacgcacgtaagttaaattaaagaaaggtaaaatgttaacactttcgtataaagaaaaattttttactacagcgagttttgttattaaatcagtaaaaaaagcaaccgcacttatccaaagaaatggaagtcctgtttttgataaattcatatggtttccaatagacgaaaaacgggcgtaatataacacccaatttaaattatcttgcgattaaacgctcgtgcgttctgtttcgcaggatctactttgatagccgttattgtaaaatcttaaacatctctctaacggcagaaggattatatcttactttataccttatatccacgctctgaaagacggagatttacggcacgttgcgataaaattaaattctatgtgagtttagttcgattattctgttgtattttaaccgctcttttccagcaaaattgaataaattagaggataaaatttatttacttatattgccattgtttggaattttctctagaatttgagaaattttaaccccaaaacagataggtaatacaaaaatgaagaaaaaaatcacttttactaaatctctcatcgcttcagcgttggcattatcagcgagttatgtcaatgcgtctgctttccaactcgccgaggtatccagttccggtttggggcgtgcttatgcaggtgaagcggcaattgctgataatgccgccgttgtagcaaccaaccctgcattaatgagtttgtttaaagcgaaacaattctcatggggggggggtatacgttgattccaacattaatgtaaacggaaaaatagacgttagcacatcaccaattccttcttctcctgatattctaaatgttaaagccaatcaaaaaaatatcgtcccgaatacccttattcccaatctgtattttgtaacccctattaatgataaatttgccatcggtgcaggcatgaatatgaactttagtttgagaagtaaatataaagatgattatgttggcggtgttttgggtggaacaagcgagatggattctattaatttgaatttaagcggttcatatcgtgtcagcaaaggattaagcgttggtgcaggattaaatgccatttatgccaaagcgaaatttgaacgccgtgcagggattttaaagaaaactattgatagtttacgtagtgatgacaatgagctgcttattttactctctccatcaatagtatcatcggcatatagcctaacatttcatgaaaacagtactgtagcacgcttacaagataacaatgcatggggattgggttggaatatcggtgcggtttatgaatttaatcaagataatcgtatcggtattgcctaccattctaaagtagatattgattttaaagataatgatacattgggttatatacttggcaaagaagagattaagcttcatcgtgcaaaaggtaagttaactttacatttaccgagctatttcgaaatttccggtttccaccaattaacagcaaaatttgctatgcactacagctataaatatacgcaatggagccgtttacaaagtttgcatgccgcttattccaatggtgaagtcgcttttcataaagatgaaaactttcatgacagttctcgtgtagctttaggggcaacttatgatgtgaatgataaattaactttacgtgcaggtattgcttatgatgaatccgccgaccacccaactgcttccattccggataccgaccgcacttggtacagcttaggggcaacctatcatttcacaccaaatctttctgtcgacatgggctttgctcatttacgcggtaaaaaacagaaatttaaagagaaccactcatttacaagcaaagataattatgaagtaggtagaatagatgcagattatcaatcaacagcacgagccaatctgtatggcttaaatcttaactaccgtttctaacgattatccaattgtttattagttatagaaggcgtattttgatacgcctttttattttttactcaaaacatcataaaatcttaaatgagtaatctaataaatatgtcaagttgcgattttaggaaaatgtcagtattcaatatcaatcaggcaaattgacgttgctctccgttaccttctacgttttcgatacaacgcccgcaaatgtgagaatgttccttatttgatccgatgtctgtagaaaagtgccagcaacgagggcatttttccccatcggcacgttccacttttatcgctaagcctgtcaattcgctttcagctacatcggctttcgacaacggtttcactacgacttgtgaggtaatcaacacaaagcgtaactcattaccgagttgttccagtaatggacgaatttcctcgcttgcatagacggtgactttagcttcaagtcctgctccaattaatttgtcgttacgtgcttgttctaatacacggttcacttcggcacgtacttttaataactgttgccagtaagtatcgtccaatttatcgctttcatctaacccaaacaaaccatcataaaattcctcggtaaagacaaattcagcacgattatccagttttggcaagtagccccaaatttcatcagcagtaaaagataaaatcggtgcaatccaacgcacaagagcttctgaaatatgccataatgccgtttggcaactgcgacgagcaaggctatccgccttagttgtatactggcgatctttgataatatccaaataaaatgatcccatctcaattgaacaaaaacgcattaagcgttgtacaactgtgtggaattgatagttatcataagcttctttgatttcgttttgtgcttctaaagcacaacttactgcccagcgatcaagagaaatcatttcttcagggttaactaggtcgttttttggatcaaatccgtttagatttgctagtaaaaaacgagcagtgttacggatacggcggtaagtgtcgcctgcactgtttaagattttgtgtgaaacggcaatttctcctgtgtaatcggtggacgctacccataaacgtaaaatatccgccccgtttttgttccaaacttcacttggcacaataacattaccgagagatttggacattttccgacctttttcatccaccgtaaaaccatgggtaagtacttgcttataaggtgccttattgttagttgcagtagataacatcaacgaagacataaaccagccacgatgttggtctgacccttctaaatacatatccgtagatttaccgttaaattcagggcgttgctctaccacggaagcataagttgatcccgagtcaaaccacacgtcaagcgtatccggcactttatgataagtttttgcatcttcacccagtaattccgcaggatcaagatcccaccaagcctgaatacccgctttctcaacacgttttgctatgtcttcaagtaattctaaagtgcgagggtgtaactcttccgtttcattatgcacgaacatagtcatcggtaccccccaagtacgttggcgagaaatacaccagtccggacggtttgctaccattttatcaatgcgagcttccccccaactaggaatccaacgcacagatttaatttcgcttaatgcttttatacgcaaatcttgcgtttccataccgataaaccattgtggtgtagctcggaaaataatgggtgttttgtgtcgccagcagtgtggatagctatgtttaatacgttccaatttaagcaatgcacccgtttctttcaatttttccaataccaaatcattggcttcaaatacgcctttaccggcaaagaatggcgttgaagaaatgaatttaccgtcatttgccaccaacccagccatttccaaaccatatttttttgataccacaaagtcatcttgaccgtgatccggagcggtatgaactaaacctgtacccccatcaacggtaacgtgatcgcctagaataataggaacagaaaaatcgtaaaacgggtgatgaaaacgaacaagttctaaatcttgacctgttgtcgaacctaaaatttccagctgttcaatttttaacgcattttgtaccgcttgtactaattccgccgccaaaattacacgctcatcaccaagttgaacaagctgatattccaattctgcattcactgcaatcgcacggttagacggtaatgtccaaggtgttgtcgtccaaatgaccgcagacaatgcaccttgacctttaccaagtgcattgaatttttcttcaacctccgccgcacttaccgccgcaaaacgcacatagattgatggcgaaactttgtcttcatattccacttccgcttcagccagtgatgaagcacaatctaagcaccaatgaacaggttttgaacctttgtaaaggtgaccattttgaatcactttacctaaagtgcggataatttctgcttcagtttcaaaattcattgtaagataaggattatcccaatctcccagtacgcccatacggataaagtccgctttttgaccttcaacttgttcttttgcataatcacgacaagcctgacgaaactctgctgctgaaattttctcgttcggcttacctaccaaaccttctacttttaactcaatcggtaaaccatgacaatcccaacccggcacataaggtgtatcaaagccaagtgcggtcttagatttcataataatgtctttcaaaattttattgacggcatgaccaaggtgaagtgtaccgtttgcataaggaggtccgtcgtgcaaaataaaggttttcttacctttcgaggcttctcgcactttttggtataaatttttatcataccagttcttcaacatatctggctcacgtttagccaaatcacctcgcattggaaaacccgtttcagggagatttagagtgtttttgtagtctgtcatattaattatttctcaactttataatgaatccaagattgttttcgcactggaatacacaaggataacccattgatttaccgaatttactaaacgaatttgtccattcagaaattcaaccatccaataatcctcaaaattaatatctgtagtattaatattgcattcttcatttgaccgagcataatctgcaccgcatactacttttgtcggcggaccatacttttggggcaatccatttaaaatatctttcacttcttgtacttcacgtgggaagggcggtctgttttggctataattcaaaatatcaattgcaatactgttcaatacttgtccattaaaataagcggttgcttctcgattattgccgttaaataaaaaatgctgacatttataagaatttaatggctggtaatattcccaaccggtgcataatttagagtcggcaatttgttgataggtcatgccgaatttaagatctttataaccgtctaaaatgatattttgggcaaaactcaagcacggaataaatgtacccaaaaccagcaacaaattttttaactttttcatgaaatgtcctaacagaatttcttgcattaacataatttatttgcaacaagaaaataagcaaaagcgatttagcattatacgcataaatccttaacggtcaaaggttcaagacttgctgaaaatacttttttgccacaacaacatcattttcaatctgatttttaagggcatttagagaaggaaattttttttcatggcgaattttatggcaaaattcaatttgcaaggattgaccatacaaatcacgatcaaagttaaacaaatgcacttccaataattgttttacgccattgatagtaggtcgcttgccaatgttggcaactccttgaaaaatatcgccattttttaaccgcacttttacaacgtatacacctttaattggattaacttgccgatgtaaataaatgtttgcagtgggaaaaccaatagttcgtcctaatttattgccatgagcaactcgtccataaatacgatatggcttacccagtaacttttctgccaacgctaaattatcttctgataaggcttggcgaatggcggtgctactaatacgccggtcatttaattgtaaacttcgattatcttccactataaagctttgttgttgcccttttttttgcagaagtcgaaagtcgccttctcgatttaaaccaaaccgaaagtcatcaccaatgcttaaaaacttcatcttcagatgtttcactaaacaatctgaaataaattgctccgcacttaattgggcaaaagtgcggttgaatttaacgcagaaaacataatctacacctaactgtgccagataggcgagtttatctcgtaaacgcataagccttgccggtgcctgatcaccttgaaaatactcataaggctgaggttcaaataacatcactacaacgggcaaattcagctgttttgctttcgcttttaaatgttgcaaaatagattgatgccctaaatgaacaccatcaaaattaccaatagttacagcacaaccctgctgttttaaaggctcgggtaaattatgaaaaccacgaataagttgcataacatcgcctaaaaataaaaatttcttgaaaattgtcgcacattatacgtataaatatacaatggtaaaagaatgcagcataagcttactttctgtttaaaattagaaaacgacaagcataaggatttttctcatctgccggacgttgttgctcaaattcaatctgccattcctgccaattaaattcaggaaagaaagtatctccctcaagttctgtttgaatctccgttaaatataatttatttgcttgaggaaggtattgcttaaataattcgcccccgccaatcaacataatttcatgatgattttctcgcacaaaatctaccgcactttgtagattgtctttccaaataatgccatcgtgttcataaggcgaacgggaaagtacaatattggttctattcggtaagggacgaccgatactttcaaaggtttttcgccccataatgatgggttttccgccagtattttgacgaaaccaagcaagatcagctggcaaatgccaaggcatttgattatttttgccaatcacatgattttttgtcatagcaacaattacacttagtttcatttactttccttcttccttatcaaaaatcaaaaaagtttatcagcgagagtgactatactacaggtttgtgtcgataaaacaataagcctggtaatgctaggccaaaaacaagtgctccaatgaggaaacctgttttgagaaaatattccgtcatttgtgctacacgttgttcattgaaaccataatgatgcaaatgaacaattgcgatcatggctttataagcgaaaacgcctgggatcattggaataaccgctgcgacagtaaaaactttcgggtgagccaaataacgatgcgataaatatacgccaataaacccaaccacactggcagctataaaagtcgcaaaaactaaaggaatatcgaaatgtactaagaaagttcttgtcccatgccccaatgcccccaaaaatgcacaatattttaaaatattcttaggtacattaaacactaaagcaaatccgacggcaggaatagctgcaaaaaacatatcatctaataactttaagataaggtccatgattaacgcccccaatcggcaatatgtaaaaaacttagtgcaaatacaattcctaaacaagtaccaaaagttaatactgttgccaaagtccaacgtgcaattcccatattaatatgtccttttagaatatcggcaagcgaattaatcaatggaaaccccggtaccaataacaatacacttgatgctaaggctatttgcggatcattacctaattcatatttaacagccaaacccgccaccatagaggcaacaaaagcggttatagcaaaaacaatcaaaggattataatgacgcaaagttaaagtttgacgaataaacatagcgatagatgaggcgataaatgtgattaaaaaaacgattatatctccaccagataaatgggcaaagcaagcacaggacaatccgatcatagtaacaactacaaaacgattgtattttaaaggcttaataccatctaattttttgcgaatctgttgcagatcatatagtcctttttctgccataattaccaagcgttgtacctctgttaccacttgcatattaatgcctttatcaaggtttttgcgtaccgtagtaatgcaattgtgatcatataatgtagtaataatgacggcattgggtgtcagtgcacattccacactatctattcccaatgcaaaacctaaacgttgtgccatttgtacaatcaatgtactttctgcaccatgctgtaataacatctgtgcaacttgtgcacaagttcttgttatttctcgttgtcgaaatgagctattatcctctgtagtattcataaaaacacctcattctattaaaaaagatgaccgcacttattatatgcttttcttctgtatcaattttgttttaaatcataaaacagcaatgaaaatcgcatgatttttcctaactttaatggtaacttatggggaaatttttcaagtaaagacaactatggaaacacaaaaaacaaataaaaccattgtggtaaaatttggtaccagcaccttaacgcaaggttcatcaaaattaaatcgccctcacatgatggaaattgtgcgtcaaatcacacagttgcatcgagcaggctttcgtataattattgttacctccggagcgatggcagcggggcgacattatctcaatcatccgcaacttcctccagcaattgcctcaaagcaattactagcagcagtaggacaaagtcaactcattcaaacgtgggaacaacttttcgctatttatgatattcatattgggcaaattctgttaactcgagcggacattgaagatcgtgaacgttttatgaacgcaagagatacgttacatgctttattagataaccgaattattccggtaatcaatgaaaatgatgcggttgcaaccgctgaaattaaagtgggggataatgacaacctttctgcattagtggctattttggcacaagcggaacaactctacttgctaacagatcaacgtggattatttgatagtgatccaagaaaaaatcctcaagcaaaactgatttccatagtcgataaaattactgatcatatccgctctattgcaggaggaagtgggacaacgttagggacgggaggaatgacaacaaaaattagtgctgctgacatagcgactcgttccggtgttgaaaccattattgcaccgggtaatcttgaaaatgtcatcgtcaatttggcttatggaaaagaaatcggcacaaaatttgttgtgcagacagattgcttggaaagccgtaaacagtggctctttgctgcaccggttgcaggtatagtaactattgatgagggagcggaaagtgcggtattgattcagcataaatctctattacctgcaggtattatcagcgttgaaggatgtttttctcgtggtgaagttgttaaaatttgtggcacgaacggtaaaaaaattgctttgggcgtacctcgctataacagcgattctctcatacaaataaaaggaaaaaaatcgcaagacattgaacagatcctcggttatgaatatggttctgttgctattcatcgtgatgatatggtcgtttattaatcagaaagtttttatcctgataaaataacaaccagcttgtcaaaagaatgtgtttagactactaaatgaagagcaaagacttcatatactcttgaagtcatatatgaataaaaacccggcaaatgccggggttggaaaagagatataaagttaaaagaacttaaccgtttgctttctcaacttgactgaattcgagttcaaccggagttgctcgaccaaagattaaaacagaaactttaagacgccctttgtcgtagtccacttcttcaaccgtaccattgaaatcggcaaacggtccttcagtaacacgaatttcttcaccgggttgaaactctttgcggtgacgaggcttatctgcagtttcttgtacacgattaagaatacgctcggcttctttttgtgaaataggtgccggtttatctggtgttccaccgataaatcccatcactcgtggaacactgcggactaactgccaagtatagtcattcatttccatttgaactaaaacataacctgggaaatatttacgctcacttttacgacgtttaccaccaacattttcaactacttcttctgttggaactaatacttcaccaaactgttcttccatttgatgtaatttaatatattctcgtaatgtcgcagcaacacgaccttcaaaaccggaaaatgcttgaaggacataccagcgttttttggctgtattttctgtcatattagaaccttaaatccgttaaaaatgtaattaatgaaacgataactgaatccaatccccataaaattaatgatgctattacagtcacagcaaatacaattaatgttgtttgcattgcctcagggcgagtaggccatgtgattcgtctcagctcaatacgagaatcggaaaaaaatcttctggctttcataccttgattagtaatagcggcgatacctaaagcaataagtaaagcaacaacaatacccacaacacgaagagctgttgaaaatttttctactaagtaaatattacttacagccgccacaataacaatagcaaccactaacaaccataaaaagccattcagacctttcgatttctgctcaatttccggagccactttattttttgtaatttctaatgccataaattagtccatcatttaattttatactggaatcctatttgaacgagcaattctagcactttcttattttattgcctatcaaaaaatataaattacgtgctatttttaatcttaatgaaaaagggatctataagatcccttttctgtcgaaacctatacaaataggagttcggtattacttaataatcttagcaacaacacccgcacctacagtacgtccaccttcacgaatcgcaaaacgtaaaccttggtccatcgcaatcgggtgaattaagcttactgtcattttgatgttatcgccaggcatgaccatttcaacaccttccggtaattcaattgtaccagttacgtcagtagtacggaaatagaattgtggacggtaacctttgaagaatggtgtatgacgtcccccttcctcttttgacaacacataaacttctgattcaaagtctgtgtgcggtgtaattgaacccggtttcgctaatacttgaccacgttcaatttcttcacgttttgttccacgtaataacgctccaatgttttctcccgcacgaccttcgtctaataatttacggaacatttctacacccgttactgtggtttttgttgtctctttaataccgacaatttcaacttcttcaccagtacggataataccacgctctacacgtccggttactactgtaccacgtcctgaaattgagaaaacatcttcaatcggtaataagaacggttggtcaatcgcacgctcaggctccggaatatagttgtctaagtgagacgctaattcaagaattttttcttcccactcagcaactccatttaatgcttgtaatgctgaaccacgtacaattggtgtgtcatcgcccgggaagtcgtattgagaaagtaattcacgtacttccatctcaaccaattccaataattcttcgtcatctaccatgtcgcatttgtttaagaatacgatgatgtacggtacacctacctgacgacctaataagatgtgctcacgagtttgtggcattggaccgtctgttgccgctaccactaaaatagctccgtccatttgtgccgcacctgtaatcatattttttacatagtcagcatgtcccggacagtcaacgtgtgcgtagtgacgtgtcgctgtatcatattcaacgtgtgaagtgttgatagtgataccacgtgctttctcttccggtgcgttatcaatttggtcaaatgcacgtgccgcaccaccaaagtgtttggataatacagtcgtgattgctgctgttaaagttgttttaccgtggtcaacgtggccgattgtacccacgtttacgtgcggttttgtacgttcaaatttttctttagacattgagagtccctctaaaaaacacggttatcgatggtacaataacaccacattaacctaatgtatgatttacggtttaattaaaaggatagttgaaacaagaagtggtgctgataggcggatttgaaccgccgacctcacccttaccaagggtgcgctctaccaactgagctatatcagcgcctggagcgggcagcgggaatcgaacccgcatcatcagcttggaaggctgaggtaatagccattatacgatgcccgcagtccataattcaactgtcccatcagaattcattattaagaatggtggagggagaaggattcgaaccttcgaaggctgagccggcagatttacagtctgctccctttggccgctcgggaatccctccacgcaaaaatgaatacttgtttactttagaatggtgccgactaccggaatcgaactggtgacctactgattacaagtcagttgctctacctactgagctaagtcggcatcgtaagcaagtgaggcgtattatatggaaaaaattacccctgacaagtcttttttcgaaaaaaaaacactttttttattattcgattaataatcaggcaaaatatataaaaattgtgaaaaaaacagttgatttagtctctttccagatacttgttttagcatttataatgtatatttttatctctttctgtcattttaagtagaatttatcgtggaagaactcaacactattaaactttctgaccacttaacgccttttttaacttttaatcggcaacagtgggctgaattgcgaaaatcagtacctttgaaactaacagagcaggatttgaagccgctattgggttttaatgaggagctttctttagaggaggtgagtacaatttacttacctcttgctcgtctgattaattactatatagaggaaaatttacgacggcagactgtcctcaaacgttttctcagcgggcataatcctaaagtaccttatatcattagtattgcaggtagtgtgtcggtgggtaaaagtacatcagcccgaattctacaatcgctattggccaattggcccgttgcaagaaaggtagacttaattaccactgatggatttttatatccactagaaatattacagaagaaaaatttgttgcaaaaaaaagggttccctatttcgtatgatactcagcgattaattcgttttttagctgatattaaatcgggtaaaaaaaatgttaaagcaccaatttattctcatttaacctacgacattatacccaaccaatttgatattgttgatcgtccggatattttaattttagaaggtcttaatgttttgcaaattgggtctaataaatcaaatcaaatgttcgtatctgattttgttgatttttcaatttttgttgatgcagaggaggagcaattaaaagaatggtatataaaacgctttttaaaattttgtcgcagtgcttttacagatccgaattcttactttaaacattatgccaacttatctgaacaggaagccatcgaaaccgcaactcaaatttgggataatattaatggcttaaatttgaaacaaaatattttaccgacaagagaacgagcgaatttaatcctaaaaaaaggagaaaaccacaaagttgaattggtcaaacttaggaaataaataaaaaataccgcacttttttaaaaagtgcggtatttttatccatattttaattaatgtaaaacatcaacaatatttaaaaagatgtttaatgctacgctatttaacagatcgataaagaatgcaccaaccataggcacaattaaaaacgctttgtgagacggtccgaaatgagaggtaactgcttgcatattcgcaacggctgttggtgtcgctcccaagccgaaaccacaatgccctgcacttaatacaacggcatcataatcacgtcccatcatgcgataagtcacaaaaatagaataggcagccattaccacaacctgtgctaacagtacgactaaaattggtaatgctaatccagccaattcccaaagttttaaagacatcaatgcgatagctaaaaatagtgataaacccactgtacctaacacatcaattgcctcatccgctactttgaacttcacaacatgagcgagtgcattacgaattaccgtaccggtaaataaacaccaaacaaacgtcggtaattgaagtgcggttccttttgtaagcacatctaaatattgcccgacaatcagacacacggacatcatcgtaatggtttcaataattgaacgagtattgattttgcgacgatatacgggcttttcaaatacctcttctatatcgtccacattttcatcttccagtacttccgctttatgcaagcgtttcaataagaatctggctaccggtccaccgataatccccccgaaaaccaaaccgaatgtcgcacaagccattgccagttccaatgccccttgaatgccaaaacgattacttaaagtttctgcccaagcagctcctgtaccatgaccacccgttaatgtaacggagcctgcgattaacccgtaagcaggatctaaaccaacaagcatagaggttccgataccgactgtattttgtagaataattaaaccaagtgcggcgaataaaaagataacgagaggtttaccgcctttcgctagacgagcaaagttggcacttagaccaattgagctaaagaacactaacatcattgtagtctgtaatttagtatcaaaactaaaactcatatcccaaaagtgatgcacaatgcttaagataatagccacaataaagccaccaaccaccggctccggaatattgtattcgctcaagaaatgtacacgtttcactaaaaaatagcccagtaataaaaccaagcaggctaatgccactgtttcataagtaccaaaagtcatattaacccctttttttgattgttgttcctgtatatattattaaatcagatactaggataggaaaaattagcaaaatatttttgcaaattcagcaaggctgtggaacgtaacaaaaaaaagcatttttgtctagtaaattgcttctttatgtatcagtaaaagtaaaatttggtagatctatttagtcaaattcaagctcaaccgcattttctcctaacattgttaccagtgcactcaataactcatctgttggataaacagaccattgcacaccgaagcgtatcaaagctcgtccgtctttactttgatagtaaagatgtattggcaaagaaccgccgctaaaaggttcaataattcctttgagttggcgaataaagtgcggtgttatttgctcttgggataagctgatggctaaattttttgcataacgactacgagcttcatctaaagtcattaactctcgtacagacatttttagcccttgagaaaaatcatcaaaactgactgtaccggaaacaataacaacggtgtccttctgtaatttatcaccaaaacgttctaaagcatcagcaaacaacgttatatctaaaagcccggaacggtcatctaaagttgcaatacctaatcggtttccttttttcgtcactgcaaatcttaatgctacaattaaaccgcaaacagtacttattttgcctcgagtgtttggagataactcatttaaacgtgtcgaactgtaatgagacaactcttttaaataacgagtaatcggatgactgcttaaatacaaacctaatgtttcacgctcaccgtctaaaatttgtttctcgctccaacgtggcgtgtgtgcataagcggtttcaacatcttcatggcttgaagttagtacaccaaacatatcaacctgtcctatcgcctcatcttttgcatgctgatccgatgctttcaacgcatcttccaaattttgggcaagtgcggctcgatgtggacccaatttatcaaacgcaccggatttaattagattttcaaaggtgcgacgattaatctgttttaaatctactctcgcacaaagatcgaataaatctttaaaaattccgccttgttcacgggctgaaactattgcatttattgggacttctccaacgccttttatcgcaccaataccataaacaatttcaccattatcattcacactaaaatgatgtttgcctgtattaatatcagggggaacaatagtgagacccatacgtaaacactcatcataaaagctcacgatcttgtctgtgttatccatctctgaggtcatcaccgctgccataaattcagcgggataatgtgtttttaaccaaagggtttgataagaaaccaaagcataagcggcagaatgagatttattaaaaccataaccggcgaatttttccactaagtcaaagattttcatggctaaatcgccatcaatcccttttgctatcgcacctttttcaaaaatatctcgttgtgccgccatttcttcaggttttttcttacccatcgctctacgcaataaatccgcaccgccaaggctgtatcccgccagtacttgtgcaatttgcatgacttgttcttgataaacgataaccccataggtaggttctaaaatcggcttaagggattcatgttgatacttaacatcaggataagaaacaggttccactccgtgtttacgatcgataaagttttgcaccattccagactctaaaggaccggggcggaataatgctacaagtgcaataatatcctcaaaacagtcgggctgaagtttcttgataagctctttcattcccctcgactccagctggaagactgctgtggtttcagcttttttcaacaagttaaatgaatcgggatcatttaaaggaattgtcgaaatatctaccgcacttttaccctctttaactaaacgagcgttaatcatatccaatgcccatttaataatggtcagcgtgcgtaagcctaaaaagtcaaatttcactaatcctgcatattcaacatcatttttatcaaaatgtgtaacaggatgtttcccttccgagtcgcaatatagaggtgagaaatctgtaattaaactaggagaaataactacaccacccgcatgtttacccgcattacgtgttactccctccaattttcttgccatatcaattaaggctttcacttcttcatcattgttataaatttcggataatctcggttctacctcaaaagcctttgtcaaggtcatacctggatcggcgggaattaatttagcaatacgatccacaaaaccataagggtgtcccaatacacgccccacatcacgaataaccgcttttgccgccattgttccaaatgtgatgatttgcgaaaccgctccacgcccataagtttctgcaacatgctcaatcacacgatctcgcttgtccatacagaaatccacatcaaaatccggcatagaaacacgttcaggattgagaaaacgctcaaaaagcaaatcaaattcaagaggatccaaatcggtaatttttaacgcataggcgactaaagaacctgctccggaaccacgtcctggtcctacaggaatatcattatcttttgaccactgaataaactccatcacgatcaaaaaataaccgggaaagcccattttattaatgacatccagttcggtttgtaagcgatcatcgtattctttacgtttttctgaccgcacttgcggatcaggaaacagggtctgcaaacgctcctctaatccttctttcgatttttggattaaaaaatcttccggacttaagtcacccgttggaaatttcggtaaaaaataagtccccaaacgaatggtgacattacaacgttgtgctattaatacagtattttcaagtgcggtaggaatatcagcaaacagctcacacatttcttgctccgagcggaaatattgttgtgaactgtataatttcgggcgtttcggatcatccagtgtataaccatcatggatagccactcgaatttcatgtgcctcaaaatcctccggacttaaaaaacacacatcatttgttgctactaaaggtaattgtttttgctgtgcaagtattaaagcagattgaatatagcgatcttcatcggatcgaccggtgcgacttaaacttaaataaaagtggtcgggaaaatattcttgataaaaagctaccgcagtttccacatcaacagaattatttttcagtaattttttccctacatcgccattgcgaccaccggataaaatgataattccctcatgatgttctgccaaccaagactgatcaatgtaaggtaaattataataaccacgttcataagccttcgaaagtaataaggtaatattatgataaccctcgttatttttggctaataacgtcagttcaaaaagttcatctcccaacaaatcacttttcacgagaacatcagcaccgataataggtttaacgcctgaggattgtgcttcaccataaaaacgaactaagccacaaaagttagtaaaatcagtcaatgccattgccaccatttcatgttgcacacaggcttttatcaaaggttttaccttagtaatgccgttaatcatggaaaaatcactgtgtacacgcaaatgtacaaaacgaggctgtgacataaaaaatcctataaaaataatttgagggaaaaagtgcggtgtattttagcgatatttctcaacaagctcaatcaaaggcaaaggacaaaaattccagcaaattattaccgcactttgaaaaaaagaaacccgactaagcgtcgggtttaatttagctaaaatgaactactgttttgcaacaaccttcccatcaacataatccacaatgacttttttacccggtaataattgtccggataagatttgttgtgctaatggattttcaatttcttgttgaatggcacgttttaacggtcttgcaccgtaaatcacatcgtagccgacttcaccgataaaatctaaagttgcatcggtaaattcaagctgataaccatgggtttccatacgtttcactaagcgttgtaattgaatagtggcaatggcacgaatattttctttagctaatggatggaataccactgtttcatcaatacggttgatgaattcaggtcggaaatgttgccctacaacggacataacaacttctttcatagcattataatccaactctttattgccttgaattaaatcagagcctaaatttgaagtcataatcactacagtattacgaaaatcaaccgttctgccctgtccatcggttaaacgtccgtcatctaacacttgcaataaaatattaaagacatcgctatgggctttttctacttcatcaagcaaaattacggaatacggacggcgacgaacggcttcggttaaataaccaccttcttcataaccaacatagcccggaggtgctcccactaaacgtgaaacgctatgtttttccataaactcagacatatcaatacgcaccatggcattttcatcatcaaacataaagttagcaaaggttttacaaagttcggttttccctacgcccgttggtcctaagaacaagaatgagccaataggacgatttggatcagataatccggcacgactacgacgaatagcatttgcgacagcaacaaccgcctctgattgtcctacaacacgcttatgcaattcttgttccatacgcaataatttatctttttcgccctccatcatttttgcaacaggaatgcctgtcgcacgtgaaagcacttcagcgatttcctcatcggtaacacgatttcgcaataaagtcatctcttttccttccgcactttcagcttgtgcaagctgtttttccagctcaggaatacgaccatactgcaactcagacattttcgcaaaatcactgattcggcgagcttgctccatttgaattttggcattgtccagctctgccttgatgtgttgagcacccgaaagtgcggctttttccgccttccaaacgtcttccaactccgcatattcacgttctttttcaccaagctcttcctcaagaagatccaaacgcttgcgacttgcttcatcatcttctttttgtaacgcttgttgttccaattttaattgaataatacggcgttctaatctatctaaaggttgtggcttactatcaatttccatacgaatacttgaggctgcctcatcaattaaatcaatagctttatccggtaattgacgatcggaaatataacgatgagaaagggtcgctgccacaacaattgctggatcggtaatttgcacatgatgatgaatttcataccgctcttttaacccacgtaaaatggcaatcgtatcttcaactgtcggttcaccaacaaataccttttggaaacggcgttcaagtgcggcatctttttcaatatattggcgatattcatctaaagttgttgcacctacacaatgcagttcaccacgagctaaacttggctttaacaaatttcccgcatccattgccccgtcagtttttcccgcacctaccatagtatgaatttcatcaataaataaaatcacacgaccttcttcttgtgccaattctttgagaaccgcttttaaacgctcttcaaattcaccacgatatttggctcccgcaattaacgctcccatatccagagaaagaacacgttttccttttaagccttcaggtacttcaccgtttacgatacgttgtgccaatccttccacaatcgccgttttacctacacccggttccccaattaatactgggttattttttgtacgacgttgtaaaacctgaatggcacggcgaatttcttcatcacgcccgataacaggatccaattttccactttctgcccttgcagttaaatcaatagtatatttttctaatgcctgacgattttcttccgcaccttgttcattcactttttcgcctcctcgcaatttatcaatggcttgtagtaaattttcttgttttataccgcactttttcaaactttcacttaaagcacctttatcttcaaaaattgctaataaaaataattcagaggaaataaatttatcttgccgttgttgtgccagtttgtcgcataaatttaataatttgaccaaacttctggaaacctgaatatccccattattccccgaaacttgtggtaaacggctcaattctgcagctaattcattatgcaataatgctaaatttcccccacttgctgttaataatggcgggattgaaccatcttgctgatttaaaagtgcggtcattaaatgaactggttcaataaattgatggtcttttcctatggctaaagattgagcttcagcaatagcttgttgaaatttagtggtaaatttatctatgttcataatctctcctaaaattaatttctgcgtttcatcgtaaaaattaactacataatgaaacgccttctattcgctcactagttaagtaagattaaacaaagatatttcaagtagaaaagtaaaataaatttagtaaaacctattaattaaatgaattttaataggttttacaataaatagagggcattaatgaaaaagttttttcccaaagaaaaataacaataaaccgaaaccgatgacaacaaaaccgataagttgccaaacatttaccgctctttgcgtcattccgattaaaccgaaatgatcaatgatcaaagcagtcagtaattgaccgacaataataaagaacagcatattggtgacgccgattttgggtgcaagaaagatagtggtaaataccgctaatgcacctaataaaccgccgatgagtttccataagggctgtttagggacttgttgtagtgctgaaaataaatccattttccaccagcaaatgaaaaataacgctatcgttcccatcgcaaaggaaacaaaggctgcaaagacaggttgtcccgagagagattgtgctaactgagtattaattgccgcttgtgcggctaatgcgatccctgcacataatgcaattaatataaatggaagtaacatttttattatcctttaaaaaattcagtgaaatgaattgcattctatacttttcaagcaaagatacaaaagctaaaatgtcgcaataatataaatcctataacatgtgctccaagttcaaactttttccataaaaaatgtatgatagacatgttattaaactaaatagcttttaagggaataattatgacaagcacaaacgtacaactcatacaagaaggcgtaaatctaatgctttccggtatgggctttgttttagtctttttattaattttaatttttgctataaaactgatgtctaaacttatcggttacttgtcatctgaaccaacccttcctcagcaagcatttattcctacaacagaattaaatgatttagagcgtttacgtccggttattgtagcagtaatagcacatcaccgtcgtcaacaaaatttacaataacggagaatataaatggctactcacgagaaaaaaatttctataactgatgtggttttgcgtgatgcacaccaatccctttttgctacacgtttacgccttgatgatatgctacctattgcagccgaactggataaaatcggctactggtcgcttgaagcttggggaggtgcaacttttgatgcttgtattcgctttttaggggaagatccttgggttcgtttgcgtgagttgaaaaaagctattccgaacacgcctttgcaaatgttattacgtgggcaaaatttattgggctatcgtcattatgctgatgatgttgtaaataaatttgttgaacgtgcggttgcaaatgggatgagcgtatttcgtgtattcgatgccatgaatgatccaagaaatatgcaacaagcgttaagagcggtgcgtaaaaatggtggacatgcacaaggtacattgagttatacaacaagtccggtgcatactttagaaacgtggttagataccacagagcaattgttagaaatcgggatcgactcgctggtcattaaggatatgtccggaattttatctcctgtcgaggcatacaaattagtcagcgaaatcaaaaaacgctatgatgtgcgtttacatatgcactgtcattcaacgacaggtatggcggaaatggcattactcaaagccatagaagcaggtgcggatggtattgacacggcaatttcctctatgagcggtacttacggacatccagcaacagaggcattagtagctacgttagataacacacagtacgataccggattaagtattccacaacttgagcgtattgctgattatttccgtaatgtacgcaaaaaatacgctaaatttgaagggcaattgagaggcgtggatagccgtattttagttgctcaagtaccgggaggaatgctgactaatttagaaaatcaactcaaacaacaaaatgcttcagataaactggataaagttttgcaggaaattccaaaagtgcgggctgatttaggctatattccgctagttacaccaacctcacaaattgtcggtactcaggcggtaattaatgtattaatgggtgaacgttataaaaccatcgcaaaagaaaccgcaggtattttaaaaggcgaatatggtcgcacaccagctccagtaaatgcagaattacaagcaaaagtcttagcgggtgagcaacctattactgatcgtccggcagatcatcttgcaccggaaatggataaactatccacagaaataaaacgaatggtaaaagaaaaaggtattcaacttgcagagaatgaaattgatgatgtattaattgttgcacttttccctcaagttggattgaaattcttagaaaatcgaggtaatccgaatgcttttgagccggtaccaaccaacgaagtaaaaacaagtgaaaaaccgaccgcactttcaagtagaaatgatagtgctgtttacacggttgaggtagagggaaaatcttttgtagtgaaagttactgaaggcggtgatattagtcatattacacctgtctcgaccgcacctagcacacaatcaacagaatcggcaacaagtgcaactacaaaaaatataccggtaaatgcacctatggctggaaatatctggaaagtactggtaaaagaaggacaacaagttgcggaaggagaagtcttgctcattttagaagcaatgaaaatggaaacagaaattcgagctgctacctcaggaactgtacagggtataaaagtgaaagcgggtgatactgtggctgtgggtgatatcttattaactttagcgtaatcggagattaatatggaaagtattctcgccctattacaaggaacaggcattatgcatttaagttgggggcaggcaattatgcttgtcatcagcttgctcttactctaccttgcagttgtgaaaaaatttgaaccgctcttattgctaccgattggatttgggggactcttatccaatattcctgaagcgaatatggcgttttcggcactggaaaatttacttcatagcaacaacaaccaacatttatctacgcttgcaaatttactgcatagcgataccgacgtacaggcaataaaacaggtactggaaaaagcaccggcgttgttacatgtgcaagcagaattattagcgaaagatttaggctataccgatggtgtgttgtccactttttatgatgtcgccattaattcaggtgccgcaccattgattatctttatgggggttggtgcaatgacggattttggtccattgcttgctaatccaaaaaccttattactgggtgcggctgcacaattcggaatttttgccactgtgctaggggcgttagcattaaacgggttagggatcattgaatttaccttgcctcaagcagcggcaatagggattattggtggtgctgatggtccaaccgctatttatctggcaagtaaacttgcccctgaattattgggggctatcgccgttgccgcttattcctatatggcattagtcccacttatccaaccgccaataatgcgtcttttaaccactaaacaagagcgtaaaattaaaatggtgcaactgcgtaatgtcagtaatcgggaaaaaatcttgttcccgatcgtgttattggtgcttgttgctttattattgcctgatgccgcaccgttattaggaatgttttgctttggtaatttaatgagagtaagtggggtagttgagcgtttaagtgatactgcacaaaatgccttaattaatattgtaacaattttcctcggattatctgttggtgcaaaattagttgcagataaattcctacaaccgcaaacgttaggtatcttattgctcggcataatcgctttcgccatagggacagcgagtggcgtcctaatggcaaaattgatgaattgctttagtaaagataaaatcaatccgcttatcggttcggcaggtgtttccgccgtgccaatggcggctcgagtatcgaataaattaggcctagaggctgatcatcagaactttttactaatgcacgcaatgggaccaaacgttgccggcgtgatcggatccgccattgcagcaggcgtgatgttaaaatatattgcagcaatgatgtaaaaatcattcccttaagattgaaaataaaaataaggacgaaaattttcgtccttattcatttttaatacaatgttagaatttctctagtaacattttttccaatttttcttggtcaatagcaaacttacggataccgtcagctaatttctcaactgccattggatcgctattgtgttgccaataaaattggctttcggttaacggttgaggttttgctttaacttcacctttaaacgctaatttacgcacaagtgcggtgctattttcttgtaattcttttaataatgccggtgcaatagtcaaacgatcgcaacctgccaattcagtaatttcacctacattacggaaacttgctcccataacaacagtgttataaccgtattgtttatagtaattgtaaatttttgtaacagaaatgacgcctggatcttccgccggagcatattctttcttatcgctgtttgctttataccagtcaagaatacgtcctacaaaaggtgaaattaaataaacacctgcttcagcacaagctcgagcctgtgcttcagagaacaatagcgttaagttacaattaatcccttctttttcaagaatttctgcagcacgaataccttgccatgtagaagcaattttgatcaaaatacgatcgttgctaatacctgcttcgttataaagtgcgataagtttacgtgctttttctaccgttgcttgtgtatcataagaaagacgggcatctacttcagtagaaatacgtcccggaacaatttttaaaatttctaaaccgatatttactgccagtttgtcttctgcatcaattagttgctgtgttttatccgcactttttgctttcgcataagcaatcgcttcatcaattaatggagcatattgcggtaatgatgatgcacttaaaattaaagagggatttgtggttgcatcttgcggttgatattttttaatcgcatcaatatctcccgtatcggcaactaccacggtcatattacgcaaagcgtctaattgtgttgtcatagtctttccttttatttagctataaagaattgaactcgcatacaataccatatctttgaaattatgaaatcattattttgcttttaagcgtacagaataagtatattcttcaccttatttataatgctttttagcacaattttatttataatcgagggcaatttttggcaaacaaaatagctcaacaatgaaaaaaaattattacactgtactttctctgtcaattttgaccgcactttatagcacgtccagtcaagcgaacttacaacagcaatgtttgatcggtgttcctcattttcaaggtgaaatcgttcaaggcgatcccaatgaattgccggtttatattgaagcagatcacgccaaaatgaatcaatcgacacatgctcaatacgaaggaaatgttaatgttaaacagggcaaccgtcatttaacagcgggaatgattgaaattgagcaacacggaaaagataatgcgaaacgttatgcgtatgctaaaaatgggtttgactacaaagataatttaattcagctcaatggtgataatgctaaaattcaccttgatagcaaagatgccaatatccaagatgcagattatcaattggttggacgacaagggcggggaactgctgatgaagttgaacttcgtgaacattatcgagtgatgaaaaatgcaactttcacatcttgtttgcctaatagcgaagcttggtcaattgaggctaaagaaatgcgtcaacatattcaagaagaatatgcggaaatgtggcatgctcgttttaaagtatccggtatccctattttctacacgccttacctacaattacctatcggtgatcgccgtcgatctggattacttattcccaaagcaggtatctcaactcggcatggttattggtatgcacaaccgttttattggaatatagcaccaaactttgatgcgacatttacccctaaatatatgtctcatcgaggttggcaattaaatgcagaaactcgctatctgactcgtatcggtgagggaaaatttgtcgttgaatacttaaaaacagatcgtcattctgactatttaaatacggctcgttcacgtcatctcttttattggggacataattctcattttctaaaagattggcgtttaaatgtaaattatacaaaagtaagcgataaacattatttcaatgattttgagtctgaatatggaaacagtacagacggatatgtagatcaacaggcgagcatttcttactatcaaccgaattacaacctttctatttcagcgaaacaattccaaattttcgataaagtagatattggaccttatcgtgcgttgccacaaattgattttaattattatcgcaacgaaattgctaatggcttagttgactttagtttattttcacaagtagttcgttttgataatgacagtgcgttaatgccaactgcttggcgtttccatatagaaccgagtttgacttttccactttccaatcgttacggcagtttaaatattgaaactaaactttacgcaacacgctatctacaaaaacgaggtaaaggagaaaatgcagaagagattaaaaaaacggttaatcgtgttttaccacaaatcaagctggattttcaaacggtcttagcaaatagacaaagtttcattgagggttatacccaaactcttgagccaagatttcaatatttgtaccgcccttataaagatcagtcggatattggtctaaaacaacaaaataatgattacttaggttttggttacgactcaactttattacaacaggattatttttctttgtttcgagatcgccgttatagcggtttagatcgcatagtttcagcaaatcaaattactcttggtggaacgaccagattttatgataaaaatgcaaatgaacgctttaacttatctattggacaaatttattaccttaaagactctcgcacagataataatccacaaaatatggctcaaggcagatcttcttcctggtctttagaaagtaactggcgtatcaatagcaaatggaattggcgtggaagttatcaatatgacacacatttaaaccaaacatctttggcaaataccgtcttagagtacaattcggagaaaaataacttaatccaactcagttatcgatatgttaaccagtcttatatcgatcaaaatttaattggtaaaaatacttatggacaaagtataaaacaacttggtatgacaacagcttgggagctaactgatcattggacactggttggtcgctattatcaagatctcgcattgaaaaagccggttgaacaatatttgggaatacaatataactcttgttgctggtctataggtgttggagcaagacgttatgtaaccaatagagcaaatcaacgcaatgatgaagtgctttatgataatagcttaagtctcacttttgagttacgtggattatctccttcagatcataaaaataatatagatgaaatgctgaaaaaaggaaaactgccttatattaaagcctttagtctatactaacgttcaaatttaacgaaatataccaaaaaacaaaccgcacgttaagtgcggttttcttttagattatgttgaaaaattacagtacatcaacacagttcaaatcttcgaaagatttttctaaccgtttagacatagattcttctgctttgcgtaaccaaactcgaggatcatagtattttttattcggtgcatcaggtccttccggattacctaattgaccttgtaaataagcttcatttgctttatagaagtttaaaacgccttcccaagttgcccattgggtatccgtgtcaatattcattttaatcgcaccgtagctgatcgcttcacgaatttcttctgttgaagaacctgaaccgccatggaatacgaagtctaatgatttcgccggaagattacgttctttagaaacaaattcttgtgaggcacctaaaatagacggttttaattttacgttgcccggtttatataccccgtgaacattaccaaatgctgctgcgatagtaaaacgtggactgattggacttaattgatcgtaaacaaaaaggacatcttccggctgagtataaagtttagattcatcaacatctgagttatctacaccatcttcttcaccgccggtaataccgatttcgatttccaatgtcatccccattttatccatgcgggtaaggtattcacgacaaattgccatattctctgccattggctcttcggataaatcaatcatgtgagatgagaacaatggtttgcctgtttcagcaaagtgtttctcgcctgcttccaataaaccgtcaatccaaggaagtaatttttttgccgcatggtcggtatgaagaataaccggaacaccatattctgccgctaatgtatgaacatgtttagccgccgcaattgcacccaatacatccggacgaataccgctagccggtttaattccttttcctgcataaaatgccgcaccaccgtttgagaattgaataataacaggtgcttttactcgtgcagcggtttctaatactgcattcacagaatctgtaccaacacagtttactgccggaattgcaaagttatttgcttttgcgtaagcaaatactttttgaacgtcgttaccggttaatacaccaggttttacaatgtctagtaattttgccatttttatatttcctatataacgtgcaattcttgcactactaaaaattaaatcaatctacaacgtaaagtataatgcttttcactttacaaaattaaccatttgctcgtttttctaaaatttcaaccgctggtaatactttgccctctacaaactctaagaatgcaccgccaccggtcgaaatataagaaattttatctttgataccgaataaatcaatcgccgccaaagtatcaccaccaccggcaatagagaaagcaccatttgcggttgcttcagcaatcgcattagaaacgatttcagtacctttacgaaagttagggaattcaaagacccccacaggaccattccaaagaatagtttttgcattgcggataatatcagccaattgctctgctgatttatcaccaatatcaaaaatggattcttctccggaaacgtcggctacacttttttcttttgatagtgcggtttctgaaaattcagtgcccacacgcacatcaactggaacaggaatattcgttacttttgataaacgttgtgcttcaggaattaaatccgcttcatataaggatttacccacattatgcccctctgcggcaatgaaggtattcgcaataccaccaccaacgatcagctggtcggcaatttttgataagctatccaagacagttagtttagtagatacttttgaaccgcctacaatcgctaacattggacgttgcggttcttttaatgctttacccaaagcatccaattccgccgctaataaaggacctgcacaagcaacaggggcaaactccgctacaccgtaagttgaggcttgtgcacggtgagccgtaccgaaagcatccataacaaatacatcacaaagtgcggcatattttttacttaattccggatcgtttttcttctcacctttatttacacgtacgttttcaagtacaacaatttcaccttcattaacgtccacaccatcaagataatcttgtgctaaacgaacattaaaaccggcacctttcaaataatcaacaacaggctgtaatgaatcttcaggtttaaattccccctctgtcggacgacctaaatgagaagttaccatcactttagcacctttctcaagtgcaagttttaacgtaggaatagttgctttgatacgtgcatcggaagtgactttcccctcttttaccggcacatttaaatctgcacgaataaatactctcttacctgctaaatctaggtcggtcattttaattactgacataattcaccccttatattggttaaaattgataaaaactaccgcacattatacctagttatgaacaggttgtaacgaactagatcaaattggctttaatatcttgttgcataaattaaatcattaacaaaaaactcacgtttctattaataataattcaatccggaataactgaaatccctattcagttttcaacggatattctttataatcagccctttttacaacagagttaaaggacatggcgttactcatcactgataaatgtacaaattgcgatatgtgtttaccggaatgccctaatgatgccatttcaattggtgatgaaatttacattatcgatcctcatctttgtacggaatgtgtgggacattatgatacgcctacctgtcaaaacgtctgccccattaccaactgcattaaaaccgatccggaacatattgaaacggaagaacaactttgggaacgttttgttttaattcatcatgcagacaaaatataaaaaaaagggcgtataaacgcccttttttgatggatgaaaagtccagaattaccagctataaccaactcccgcacccacagaagttttcttatcaccatgtcctaagctgaacttaacgctaagtttgccgttatcggacactctggaataacctaccgcaaaggcttgactccccatatagttaccggtcgccaaacttaacgtacttttacccggtaatatattgaccggtaagttcgcttgtgcaacagcttgtgctacacccgcacgcatattgcgatcattattgttcatttgtgtccgcagttcattgtttttggtatccacgtagtttttgtttactaccacatgaccatctgcattaggtttaatattcggcacggtgataaccccttttgtaccatcaatgtgaatctgaccgcctgcaccgttcactgtcaatccgtttttgttcagctcggtacttagtgcggtcgcttgggttgaactgtccgcaaaacggataccacctgcggtcatcacagccttatcgcttttgtttttatcttccaacaccaccgcttccgctccataagttgcagatttggctttatcatcagtgccatctttgcctttattgaccactctcaaaccgttgctatccaagsggggytttctaccgttcacttcacgagtttcaaacgaagtcatgttytkyarctkrtcrgacaatttaacttctaagcctttgccgtcttgtgacatttccactttgatattrcckgyggcrgtgmggtygctgttaaaygttccctcgcctgtgatggacagggtttcaccgacatttttatgcacggttacatcatcattaccgacaaaattcagccccgctcgtgccacggcttgtaaatcgccaacggtagcgacrttgcttaamtyrgcttsgctatccggttcaaccagttcttcgacttttgctatcgcctcggaaaaggcgttatagtccccatttgcttcwattaactcgttgcgtgccgattctacggcttctttagcattctttttagcctcttgagcatctgacaattgmgtttcgtattttttcaaatyctcacgmattttytctttmgcttstccatcaggcatrgtrtcmacggtttgttttaaactgtctaccattaactgtaaatcagcaaatttttctgctttctcagaaaaatctttcattttttcaccyaatgccgtcactttttcactcacttcctcagcaagctgattaagtttttctttttgttcgtctgttggtgttgtaatacccaaaccactcgccacattgctaatcccgataggtgcggtgstyggttcggctttaatcacgacttktttctyctcttcytcagwaagtttttcactaggtttaccgtcttttaattttttgaaactgccatcagcccctttcacgactttttcgccattcagataaaaatcaaacgggcgattattgtttaagtcggatactttttcatccacatagtttttattcgctgcaagggtgccgtctgtttcatccggtttaatatcagcaagaccggtgattttgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtggcgtgagtgaaataccatctttatcrattttcactttagaacctggtttgccaacttggaaagtagcaccattatttggatctaaagtaagtttagtgacttcatcttgatttccaaccgcacttgaacctgcaccgcttccgcccgcacttccatctttaggtttagaggaaatcgaggtgatgtttttcaattcctcagtcgtgccaatggttaccactgccgttgttgttggggtagtggtagttggcgtggtagttggtgtacttgttggcgttgtcgtagccatgcctgcaccatttgaaccacctgacgaagccatactatttgaaccaccgccgtttgaacctgcaccacctgatgaactgcttggagctgctgatgatgctggtgctggagcagctggtgttggagccggtgcggaagcactcggactggtagatcccgtacttgatggtgttgtaccgtttttagctaaatctactttaatattctgaccactcgtaaatttcaacgtatcgccacgaccgatttcaacagtttgaccgccaccattttcaaccttgaacttaaagctacttaacgcttcttcaagatagcctttggtgatgagttcatttttccaatctgtacttccactatttcctcttccgccatcatatgtttgctctttagaaagcattactttrctaaatatcggtgcrtytttaaasccgatttcgattttggcgttgccgttagtttctctcgtgtattgagtgattaaattatcacctttaaactcagcaatatttggttgtgatgaagtccccgccggagctggtgtagcagacgaaccagcctgattcatatctaaacgaacaatattaatrgtcgaaccragatagtgcggtgtgttttgagtgccatttgttmccgcactwggaatatcascrcygaayttyaagccctcgttgagtttmkwwacagyattttkcaagccstcwacnatrtttkttggtrcwkttccatctgttccwkyaaccycttttaatttrarrtyatyaaatgttggwgckktaaakkysgttttakytkwakyatcaacckcaatacctaaytgtttmgctaaatcmgccagttgtttacctgttacggcktcttttgaattctcagcaatttcaccgtctgcaaggtttttgagttttgaatcattaaagctgatttcttttttagctgtttctaacgtgattttygctccamtttcatctttaccgcytttratactggtgatttcttkaagmtyaytattmarygwatgcktaatwwytccmtyakcytcyacagmaacagaaatattttccgacttcwygaagtccaacgcccctgttttgaggttgatagattgtttcttgtygtcttgacyattcgctttatacgataacgtcaaktcgtccacatattkcttattracggcatcatatttatcagttggtgttgcaacataaacaattcktctttgttcatctttgcctgagccgcctacagataccgcatytgmtwcwsctkttgatttrttgcctaaaatgacrgcatttnttaymtyktyagytgtcgtrayayttgaacccaagacatargtgtgttcgcctttgatgtcattataagcacccacarcataggaatgctttccgctaaccgtgttttgtttcccgaatgcaccggaatgattgcccgatacattatttttgtaaccaatagccgtagcatgctcgcctaatacctgagcttctctacctatggcaagtgagtttctatttttagcgttcgtgccatagccgatagcaattgccctttcattttttgccactgctttatcccccaccgcaattgagccttcgccatctgccttggtttccggattatcggaaattttaacggatttatctcccgtgccttttagatacttgataaccgcatccgcctgtactaattcagtgctgcttttttcagtttcgccgagtttgatgttatcaatcccaacattttttcctaaagctcattttttaccgttaatattcgatccatccactttcaggaagtctttacccaactgtgctgttgwsgtrtaytytttcaaytytkywgctacsgctttwgargtmacracttttycatcgctktcrkmmacyktrkykgctttatttaatttcagygtaagtgtacccgcactttgaggattgttaccattagatggtgctaatgatacggtgatgtctttttgtgtggcttctgccataccatcggcttttaccttacttgttgaactatcaatggtcaacgtaccgcctaattgtaatgtggttgagcttggggagctaccattatcattccccttgaatgtcaatccaccattgaccgcagtaattaaytggtcrattgcacctttraaggttgtaggacctgtattgctattagtcgtgccagcagttgaactcgtaccgcctttaatggcagtaaatgacggttggctaaatccggtttcactatcaacakcaaccccyaatttacytgctaaatcatgaagttgtccgccsgtratrgcttctgatgaactactttctatcttaccaaccgccacattcgarattttcacggtwtykccrctatcsgatttagtaaaggtyaaygmwyttccrccgacttttaactccgccrttttgtcagtgycactcgtaccatttttaaacactaaagcrttatcaccatctaacccaaccgtagataaccccgtggcttgcactccgccatttgtcatgtcttttttcaacataacggttgagccgttttccggacttaactcaattttgttannnnnnnnnnnnnnnnnnnnnnnnnnnnnnnnnnnnnnnnnnnnnnnnnnnnnnnnnnnnnnnnnnnnnnnnnnnnnnnnnnnnnnatctttagtactttctaaggtaaccgctttatctktcaattcmagtttkgawttatctttggcactttctaacgttgcactattgtcagtaagttttaatgctcctttattgtttcctttgttaatttcagaaacayyrctaaatttaccygcacttagggtgacrtcttttgwkcytgyttggtckccwgckgtraacgtwatggyttttttrtcattctccaamgcrattttkgcgttatcaccattggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacccacaattttcaacgtctcgccgagtttgcgggtgacatcttgagcgtcatttccttggaacttcagccctttattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaaaccgctcgcaatgcctgtgatttgcttattatttaagtctaatctatcagcttttaatgtcagatctgttcctttagaagagattttgagaccatcgctatttgcaaagtcaatctgcggagtcgtgccaccgttatctttacctgcaatcgaagtgatatttttcagatcggcatttaatttatgcgtaatcgcaccgccagcatctgctgtgacagtgatattatcatcatttttaaaatcaagaccttcggaaagtttaactttattatcacctgctccattagccttgtattttatctcttggttggcaatcgcttgctcgttttgagtcgctttactgtccacatattttttagtggttaaggcagtctttggacttttctcatttatttcttcagtgaccgttacttgtttaaaagatggtttatcttttatgccaattaaaagctcttttgtatttggttgatatgatgttttaatattatcgctactaaatccatcatcactggttgattttttatcgatattccctgctttaatgtgtaaggtatcccccagttgaagcgtgcctgttgctataccatcgctcacgaccagtcctttattcaccgcgacgatcaaatcatcgattgcttttttaaaggtagtttttccgttagttgctgtttgcccttgataattgactttggtaaaggacggttgtgtaaatccagctttcgcattatcgacagtcacacccaatttgcctgccaaatcatgcaattgttttccggtaatcgcctcatttgaagcaccgtcaatttgcccgtctcccagtccagaaatcttgaccttatccgtatcggattttgtcaatgttaatgccgcaccttcttcaggcattaactttattttcgtatctgctaaggagatttttgttttgtctttagcgatagactcaactcccgtcaatgttgaacttaatccataagatattttyttattagacttatctaattcaacagttaaattagaatcttttgctgcaaattctaaagtatttcctattaggttatcgctagtggtacctcctgccttaaccataaatgttttattaagtttatctttaataccttgatcaagttttgcctccgctattgtgttatcttttaattttgtccctgcaattgaagcatcttttaaacttaatgacgcattaccaaatacttttccgccaccagtaacttgaatttcatcgttaccagttaaagccttcaatccactttcaataactattttagaagccccgccgtcaccgtgttgaactttaacatctccagtagccccatcaacagtaatttttcctgttttatttgtagcactatgaccactactatcttttagagtgatagaattaatgtcttctaagtctttatttagtgctaccgtaaattctcccgtcttatcagaatttgttttagataatgaaacattgatattgcttcctgatttaatgacaacttttttgtcgttctcgctattttttctgacaaagtcattattcgtagtcccatcactaaaggtaatacctgccccatttaccgaagtgagcacctcatcaagagcagataaagcctctcccacggttgtgtatggtgccttatttccattagctagtgtataagacggtgctgttacatttccgtctgcacctattttcgcctctccgcctaaagcactcacaacaaaattgagttgcaatttgttaatagcatcattatcagatgtaccatttgctacgttggaaattttaactttgccgccagaatcagttaaatttaaactggaaccaccagctttaagggttgtcccgctatccaaaaatgcgatttgattattggtatctttaccaatagatgtaatgcccgttaaagcctcttttaatgtgatactgacttttttattgtccttatcaactttagtttcaatatttttagtatctccattaatatttaagacattgttctgtttatttaatgtatatactacgttattatcccccttaacatcaaaattagcggcgacattagctaatttcccgtccacataggttttcgtggttaatgtcttcccatcactactatcatcgactgttccactcactttgacttctttaaaggtcggtttgtctttgataccgattaacagctctttgctttttgctagatacgctgttttaatattatccggtgaataaccgtcgtctgaagtgctcgttggtttatctacagctcccgctttgatgattaatttatcgcctaagtaatgcgttccttgttcattattagaatctccaacaccaaaaataaatcctttattaatcgctgttgtattttgaccaatggcatctttaaaggtcatttcttttgatgtttgagtatttgtattcccattatatttaacaacatcaaaacttgattttttaaatccgctcgttaggtctgcctctgctcctaatacattaatagctaatttagaaaacgcatctactacgccatataactggcttccgttaatagcgtcggtggagtttacttccactttacccgcagcaacgtgagtaatcaggtgttctttgccggtatcgccaacactgatcactgattttttactctgctctttgtcatcagcactgacaccgcctgtccagttgaatttaaggttgtcactgccgacagtcacttttgcttctttaggtgcggtcattttatcgacagtttttgcatttttacccaatgcgagcttatcgccatctaccgtaatcatgcctaatttgtttttggtattttgggcaaaactgagagtgatactttgtttatcctgctccacttttgtctcaatttcatcactcgttcctgccactttaagtttttcgtttttcaaattcactttaccggtcggaccgctatttttagaattatccgcctctaaccctaaggttgtactaatcccatcaattttcgaatccagataagttttaaccgctccggcggtgacaactttgtctttattgctatttgttgccgtattgtcatcaatgcttgttgctttgtgcaaagtaaaggtaatttccccttttttgctatcagtcttagaagtcagatccgtaccattgcctttaatggtgagtttttcgcccaatttacgggtgatttcagagccggaatttccggcaaatttcagtcctttttccacaatcgctttcgccacgttggataaatcgctgacattgacagcatttcctttaattgttgttatgtaactgccatctaatatttttgaaacattttccggatttccgttcgctcccttaggtccatgatgctgtgtatttaacccgctttgtaatcgggtaattcttctatcggacatatcaaagcccgttctatcaaatgtatagtttgccccatttgatgaaattgttacatttgtcgttgcatttgacccatttgtgctattaaatgctatcttgctatatacagtatttttaccgcttttaatcccttctccagtaatacttgcaatgtcttttaagtctttatttaaagatatttccaactctttttcattagttttagcttcagtagtaatatttttatgtcggctagcgtctgctttccccttaatatttaatgcattttgaacaatatagtttcccgtattaccatttacagtaaaactagttgcaacattggcaagttttccgtcgacatattctttcgttgttaatgtctttttatcgcttctatcattcacagtgccacttattgttacttctttaaatatcggtttatctttgataccgattaacagttcctttctggttggttgatagcttgtcttaatattatcactgctaaatccatctacatcagattttggtttatcgatatttcccgctttaatagttaacgtcgaacctaaattaagtgtacctgtatggctgtcagcgtcttggattacaattcccttatttaccgctgtaatcagttcttcaatagcatctttaaaaatagttttttgtttcttttgagaaccttcatagtcaaccgctgtaaacttataactatcaaattgcgtgttattgggggtatttactgacacacctaaaatatcacccacatttttaagctgattccccgtaatcgcctgatcagaagtttgcgaaatctcgccatcggctaaatgcccgaatcttattgtttcccctatgtcagcaatttgtttatcagcatctatgtattgtatcttctcgttatgccctttagccccaactaatacttnnnnnnnnnnnnnnnnnnnnnnnnnnnntggtgttccatattttgtattgaccttatagaagttgccatctgttcctttaactaatttatatatttttccattatcttgcgtataataaacgactaagccttctctttttacatattctaaggcttttaattgtccaatcgtcgccacgtcagagtccaacgcacccggtgctaccccgacaatccgtcttaagcccagttcttgactatcacttttaccctttgtccaacckacygacacratacccgckgttttatcggttstnaarttatagctagaaccctctggaatataaggggctaaattaatcgcatcttgtccgctgagcgtggctgtgtttttgttatcatcctgatagaaatattttgtatgtgatttatagcctaaggcaacggaattttccattgttgcttcggtttcattacctaatgccatcgcactttttttagtcgcttttgaagttgcaccaaaagcaattgcattttcagaatctgcttcaatttttgcattatctcccaaagcaatccctttttcagaataaacatgtgacttggtacctatagaaatcgctgacatttctaattctactttgtcacgctcagatccaaattttctgtttttctcattctctattttttgagttagattttggcttttattttcaattcttgcattattaccaataacaatagatttttgagcgtgtacttttagacttgcatcatttcccaaaacgatactttctctagacaagccatgagaaccataccctattgatattgtattgtcttttgtaacaccaactccggaacctattgcaattgctcctgcaccgaagacatttactcctgtaccgatagcaacagagttttctttatatacattagtaccaataccaagtgcgatggtatttcgtgcatattttccaacattatttaatgcacccaatactacagagtttgctccccttactactgatgcactacctatagcaatagtattatccccattatttgaaagatgatatcctaaagatatggcgtgatctccttctttagttgttttatatattttttttgttgtttcaattacttcatcatgttcgtaagcaaactttatattttttttgtcgttaattacttgttcaattatctttgatactggatttttttgattatcaggattaagtgccctaaatccaagtttaacaataggatttttatctccatattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcatttgatgatacattttcgcctatcgcgattgatccaaatcctactgcttttgatcctgaaccgaatgttagtgaacctttattagttgcttctgcttcgtttcctattgcaaatgaattagttgcaaaaacccttgattcgtctcctatggcaaccccaccttctgcatctgcattaacaaacgcacggataccgacagccgtagaatcttttcccaaagcaaatgataatgtaccaattgcaagtgaagcatctccaaatgcaacagaccttgatccaatggctattgcacccactcctgctgcatatgttggagaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatatcatcattacctatggcaatagaagcatagccagcagccataacatctgatcctatcgctgtagcttgttctccaccagtataaacattgtttcctatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacacccgctgctccggtatttccgtccatatcaatatatgttatgtcagcatatgaaacactgctcacaccaagcatccccgacatcaacaacaccaacggtgaaaatttaaaaatgcctaaaaaattacccaaaaacacaccgcactttggtttactcttcgaactgctcgctatttggcggttgcttgccaactcagaaacggctttacattgacctgttgttacatcgtattttgttttgaagattttgttcataaattcactctctttaagcttttaaaattaggttttttattgatttattttgttgatttttttaacttttttatagttattaatggattaaaatttttgctttttaggcagattaatgaggtataaatcggcgatgccttgctttttaagacaaagcagaaaaagnnnnntaatactttcgccgaaaggttgaggttgaaataggtgatttttaagatattgtttgaacatgtccaacctctcaaaattaacttgaaaggttgattttagccaatatactaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctcattctattcctgttatatgtcgtgaacaaataatgtatcgagccgattattctagcctaactattatgagaaacaaaaggattttttagttaaatctgatttgatgtaagaaggctttggtgcgttcatgttgtgggttttcaaataacgtttttggcgatccttgttccacaataatgcctttatccataacgaccactacatctgccacatctaaagcaaatttgatttcatgcgtgactacgaccattgtccaaccttcgttagcaagctctttcatcgtgtttaatacatcttgaactaattcaggatccagtgctgaggtaggttcatcaaacagcattaattcaggtcgaatagctaaagctcgtgcaataccaactcgctgttgttgcccgccggaaagttggtgtggatagagattagctttgtctattagccctactttacataataacgtttccgcttcttggcgtacttcatcaggcttgcgttgttgtacttgaacaggtccttccatgatattttctaatgcggttttatgtggaaataaattatattgttggaataccatgcctgattttttgcgtagcggtaaaatgtttttgcgaatgtgtttgtccgtaaaatcaatatacagcggattttctttgtgaaattcgattgtgccttgttccggtaattcaagggcatttaaacaacgtaaaaaagtcgttttacctgaacctgatggtcctaagatgacaacaacttgacctttttctatatctaaatcaattccacgtaatacaggattattgtcaaatgttttatgaatattacgaattttaatcatcatttatccttggttagcgagtaacataacgagcaagttttttttctatgcgagcttgccataagaacaagataaaacagaaacaccaataaatcagggctgcctcaatataaacgggtaagaaatcgtaagacatatttgctacttgttgtgccactcggaacatttccgttactgttactaccgaagctaaagaagtgtctttgaataaactgataaatgtattactcagaggcggaacggcaacacgaaatgcttgcggtacaataattcggcggaaagtttgcatataagtcatgccgattgtgtaaccagcttcccattgtcctttggggacggattgtatcgccgctcgtaccgtttcagaagcataagcaccgacatttaatgagaaaccgataattgcggcaggaataggatcaataaaaatccccagtgcaggtaatccataaaaaacgatggatatttgcactagcattggtgtcccacgaataattgaaatataaatttttgttataaataaaaagaggcgatggataatgctgtggctcggactcactcgaattaacgcaacagcaatcgcaataaccattcccaatataaatgatacgatagcaagcggtattgaaactaataccgccgctttgaccatgggaaaaaatccattgatgactaattctgctcttgcctcagtcataaaaggcaatgaggcaaggaaattatttaacactgatatctctaccaaagaattgttcacctaattgttttaatgtgccatcgttgcgtaattcttcgatagctgcactgatttttgctagtgcttcatcattatttttattgacaataagacccgcacccactttattttcagattcccataccggttttaaacctgaatttgggtattttttcaaataatccaataaggctagtgcatcgttaaacgtcatatctgctcgtttttgttgtatgagtaataagccttgtgccatgccgtcaataggaacaatcttagcttggtatttttgtgccaattcaccatagtttgagctaagtgtttgtgctgcttttaagccttttacatcttcaacttgtttaatgcgagtttcattatctcgtgctactaacattgctccggaccaactataaggttcagatttgtcaaaagtggcttgacgttcaggtgttgttaatgcgacttggtttgctaccaaatcaaaacgtccagcttttaaaccggcaagcatcgcgtcccattgtgtttctttaaattcaacggttacacctaattttttagctactgcacgagtcacttcaacatcatatcctgtcaattttccggttgagtcatggtaagtgaaaggtgcgtaagttccttctgtaccgaccgtaattgttcctttgttgttaatgcgatctaataaactcgcttgagctgaggcttgtgtgttggcgactattgcaaaaacggtagtgaataaaaatgttatttttttcaacataaaagctcctttcagtaaaaattgggttgcggtaaaaaagagtgcttggcattgtaaaagaaatgttaaatattacaaataactttcgggaatatgttatgcagaatgggtatttttatgaggcgatgaaaaatgatccggattcaacgcctaaagcttaagctgaaaaattagcaagcgagtaaaggaaaatcaagcgatatttcgttatataacttgaaataatactgaataatagctatattacgacaaagggcgtaagctgccacaagtgctacttaatcgggcgtaagctgccataagtgctacttaattaggtgcaagctaccgtaagtgctgaagaaaagatgcctaacggcatcttttttttgctcaaattctcatttggaatatgacgatgaatgacaaattaaaactatatcgtgtaacggatcactatcttgattttttaagagatgttgagcctaaaatcccaatgaataaagataatggaaaaaaacgcccttttgttggcattgttctttccattaacggcgtaaaatatatcgcccctttatcttctaaaatttgcaaaagccaaagcgattttaaagtgaaaagtggcggtgaacaaaaggcgactattcgatttgcgtatatgttccccattgttgatagtgctttaattgagattgattataccgaagaatttaaaatagattttaaatatacggcattgctcatcaaagaggacttatacatcaatcaacataaagcacgtattcacgaaattgcaaccaaaacgtatactaatgcaatcacaaaacgctttgggtttgaaaatttctgttgcgactttgcaaagctggaagaaaaacatcgagcttatgaagctcagtaaaaattgctccagtgtatctgctagggatgtttttatagaaagtatatttagaacaataggttagattgaaagtgcggtgttgttttggtggttttgataaaaaaatgagctttgataagtgaattaggacttaaaaaagctcattttgtcatatcgaaaaggtcaatgtagccagaataaataggcaaatgtaccgataaacagtacgcaaataatatttaagacaacacctgcacgaaccatttctttttgtttaatttcgcctgtaccaaagacaattgcattcggcggagttgcaaccggtaacatgaaggcacaagaggcacctaaaccaatgatcaatgctaaacctaattcaggcatgccaagtgaccgtgcaatagaaatgaagataggaactaataacgccgcacttgcactgtttgaggtaaattcagttaagaaaatgataaaggcggcaactaataaaccgataagatagaagttcccaccttcgatcatgaagactatgccgtcagccaaaactttgctcgcacctgagtcttgtaataccgcacttaatgttaaaccaccaccgaaaagcattaatacgccccaatccgtattatcttgtaactgtttccaagaaattacgccgctgacgcaaacggcaatagcggcaagtaatgcgatgacactgtcaaaactggcaatatttttttccaaccctaataaagatgacagcattgggttgagtttggcactaaatatccagcaaaatgcaatagttacgaaaatgagtaatgtaatgatccgttgattattcatctcaactttctcaaagttttgtttgaaactcgccttgagattcggtttaaagataatgtaaagagtaccgatcatgattggcataagaataagcatgataggtaaaccgaaatagagccaatcggagaaagataatttcaattgagaagcaacaattgcgttgggcggactaccaatgacagttcccataccgccgatactcgcactgtaggcaatacctaataagacgaatacataagtgttatgttctttcgttctatctaattggctaagaatacccatagctaacggcaacatcatcgaagctgttgcagtattgctcatccacatagaaagaaatgcggtaattgagaaaagataaatgacgccaataaagagatttccttttgccagcatcattattttattggcgatcattctatccaatttttgaatatgcagtgcggtagcgagggcaaatcctccaaagaaaaggaaaatagttggtgctgaataagaagctaaagcggtttttgttgtgactaaacctaatgcaattgctataaacggcactaataaggctgttactgttacatgcagtgcttcagttagccataacacagcaataaagactaataaagccagtcctttatttgctttttcatcaaagggtaaaacataaagtagaacaaaaaaaacgataacatcaagaatgaatattaacgcattttggttaaaaattgatttagacactgttttgctcataaggttatcctgcttagataaaatattgaactatccctatttgggggtaggaatttgagtgaaagttaccaaatggtaaaaaaaatgcaacgaccttttgttttttttgtgaggtatgtctaaaaaataaaaagtgcggtcttttgcaccgcactttttgtaggaattaatgctgaatggtgattataagctatcaaactcttctaaatctaaaggctcttgagaaagaataatgccggtaagatctgcataaacatagtcatcaggaaagaaggttacgccaccaaaatttaccggaacgtccgtttctcctatgctttgttcatctgaaccgacagggataggtgcaagtgcttgaatgccgatatttatgttttctaattgttgtaattgacgaattgctccgtatacgataatcccttcccaaccgttatctgccgctaattgtgctaagtttgcatcaattaatgcacggcgaaccgcaccgccaccatcaattaatagcactcgaccttcgccattttcttcgagaatttcactgattaatccattgttttcaaagcatttgattgtggtgattttcccaaagaacgtgcttttgccgccaaaactggaaaaaataggctcaacaacatcaatttgatcgaggtaaatatcacaaagttcagcagtatcaatatacatagggttttccttctatatttcggacagttgttaagtataaccaatattagtttacaagcaagctcaaactgaataatagattcgtgaacaaggcaagtaaggacatttgtgcaagcattgggcgtaaatgtaacggatttttattgcgatacacaaaatgtgcatgcttgatcagcagtggaaaagaaagaataaagataaaatttgaccaatgtgtaaatgtgtataaggcaaaaataatataacttaatgcactgagcaatagaataatgcaatgataaatacgtgcattctcagcccctaaacgtactacaagggtatttttacctgcttttctatcttgttcaatatcacgcaaattattgatatttaataccgcagtagctaataagcctgttgcggtagcagggagaaaaataagccaatttagctgatgggtttgcagataataagtaccgccaacaccgagcagaccgaaaaatataagtaccgaaacatcgcctaaacctaaataaccataaggttttgtacctacggtataagtaattgcggcaagaatggcgagtaaacccaaaagtgcaaaggcaacaagatcaacaattgtttgataagcattcacaatcagtaaactgccggaaatcaaactcaagaatacaacaagaataagtccttgttttaattgttttgcgttaatagcaccttgttgaatagcacgcaacggtccgatacgttcttgtgtatcggaacctttttgatgatcgccataatcattggcaaagttggataaaatttgcaatagcaaggtcgttaataaacaaagtaaagttgttgtccaactgaattgttgtgcccaataagccaatgccgagccagtcataattgaggcggcagccaaaggtaaagttttgggtctagctgtttcaaaccacattttgacactattatttgccataatatccacattataattgatacaaaaaatgaaattttcaccgagcgtgtacacttgcgttattctactgttttattgatgagtttttaactgttttaaggaaaatatgtccggttttttacttcaactgacaccgattgcgataattcatacgccgtacaaagaaaaattttccgttcctcgccaagcgaatttagttcaagacggtacgggagttgtggaattgcttccgccttttaatagtcctgatgctgtacgtggactggagcagttttctcatttgtggttgatttttcaatttgacaaagtgccgacaggtaaatggcaacctacggtacgccctccccgtttaggaggtaatgagcgtattggtgtttttgcttccagatcgacacatcgccctaatcctttggggttatctaaagtggaacttcgtgaagttgaatataaaaacggaaaggttttgttacatctcggttcagtcgatttgattgacggtacaccaattttagatattaaaccttatattgcctatgcggataatgaacctaatgcaagatcgggatttgcccaagaaaagccaaagcaggaattgcgagtggaatttagtcctgaggtgcaggcaacactggaaaaactggaaaaaaaacgaccgcacttgaagcgttttattcgagaagttattcagcaagatcccagacctgcctatcagaaaggaaagcgttttcataaaatttatggtatggcactgtatgaatttaatgttcgttggagaattaaacatgatgattttacagtggtggaagtgattcacattcagcatgtttgatcttcaaataaattttttgatccacttataagtgagatgtttgtggagcatgccgttgtggcgaaagaaattagagaaaaatccgcaaattcataacgcacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncataaaatttatggtatggcactgtatgaatttaatgttcgttggagaattaaacatgatgatgatgttacagtggtggaagtgattcacattcagcatgtttgatcttcaaataaattttttgatccacttcacatttttacagttttcttttttctttttatgaaattttccattaaactactttttgtttaatcgaaacgtttcgatggtaattatcaatgttttctctgaataatttcagaaaaactggagaaaattaatatgaagaaaacaaaattattaaatgcgagcttatcacattatattgcaacgttaggccatacagacagtttggttatttgtgatgccggattgcctatttcaaatcaagttgaacgtattgatttagcgttggaggcaggcgttcccgcctttttacaaactgttgatgtggttataagtgagatgtttgtggagcatgccgttgtggcgaaagaaattagagaaaaaaatccgcaaattcatgacgcacttttagattcgttaagaaaattatcagaacaacaaggcaactgcattgccgttgaatatgtagaacatgaagaatttaaagtattaagttctgagagtaaagctgctgtacgtacaggggaattctcgccgtatgctaatattattttgtattcaggtgtgccattttaaccagttgaagagaggtatttatgcaagtggaaaccttgctcaaaattaccggcgtagataaatcttttccgggtgttaaagcacttagtaatgcttgtttatctgtttatgcgggacgagcaatggcacttatgggagaaaatggtgcaggtaaatcaacgttaatgaaggttttaaccggaatttatagcaaagatagcggttctattgaatatttaggagatgttgtcaattttaaaggacctaaggattctgaaacggcaggaattagtattattcaccaagaactgaatttagttgcaaatttaaccgttgctgaaaatatttttttggggcgtgaatttacaacctcttggggagcaattgattggaagaaaatgtacagagaggctgataaattattagcacatttgggtgtgtcatttcgcagtgatcagctttgttcggaattgtctattggtgaacaacaaatggttgagatagcaaaagcgttgagctttaaatcaaaagtgatcattatggatgaaccgacagatgccttgacagatacggaaacggaaacgctttttaacgttattcgtgaattaaaagaacaacattgtggcattgtatatatttctcatcggatcaaagaaatttttgaaatttgcgatgatgtaacagtattacgtgatggacagtttattggtgaaagtgcggtgcgagatctcacggaagatcgtttaatcgagatgatggttggccgccgtttagaggagcaatatccgcatgttgaacaagatcgtggttctgttcgtttggaagtaaatcagcttttcggtagcggaatatgtgatgtgagctttaaactatatagtggtgagattttaggtgtgtcaggcttaatgggtgccggtagaactgaattgatgaaagtgctatatggtgctttgcctaaagaagaaggtgaagtgcggttaaataataaagtcatttctaatgattctcctcaagacggtttaagaaacggtattgtatatatttctgaagatcgtaaaggcgacggactaattttgggtatgtctgtaaaagaaaatatgtctttgaccgccttggatcatttgtcaaaagccggaaaaattaatcatcaagcagaaaaaatggtggtagatgattttattgagttgttcaatattaaaaccccaaaccgtgaacagcaaataggcttgctttctggcggcaaccagcaaaaagtggcaattgctaaagggctaatgactcgtcctgatgtacttattttagatgaaccgaccagaggcgttgatgttggtgcgaaaaaagaaatctatcaattgattaataaatttaaacaagagggattaagtattattttggtttcatctgaaatgccggaagtacttgggatgagtgatcggattttagttatgcacgaaggtcgtattagtgctgaatttagtcgtgaagaggcaacacaaggaaaattacttgccgcagcactcgggaaacataattaagggaattgtatgaaatcatcatttaaattgggaaaaatgttattagagcaacgttcagttattgctttgttgatacttattgctattgtatcaatgattaatcctgactttttcagtattgataatattcttaatatcttacgtcaaacgtcgataaatgcgattattgcagtaggtatgacttttgtgattttgattgcagggattgatttatccgtcggttctattcttgcgttgaccggtgcggttgccgcttcattagttagcatggagttatccatttttatggttattccgttaacgctattattggggacttttttgggtagcgtaagcggttttatcgttgcaaaaggcaaagtacaggcatttattgccacattagttaccatgactttattacgtggtgtgactatggtttatactgaaggtcgtccgattagtacgggattttctgaaacggcagacagctttgcttacttaggtacaggttatttattgggtattcctttgccgatttggttaatggtaattgtgtttgcggttgcttggtatgttttaaaacactgtaaaatcggacgctatatttatgctttaggcggtaatgaaaatgcaacgcagctatcaggcataaatgttaatagaattaaaatatttgtgtttgcagtgagcggctttttatccgcacttgccggattgatcgtcactgcacgtttatcttcagcacaaccgacagccggtgtgtcttatgaattagatgcgattgccgccgtcgttgtcggcggaaccagtttaatgggcggtaaaggtcgtgttatgggtacattaatcggtgcattgattatcggttttttaaataatgcactgaatttattagatgtttcatcttactatcaaatgatagcaaaagcgttggttatcttaattgcggtgcttgcggataactatttaggtaacaaaaaagcataaactcaatatctttataggagattttaaaatgaaaaaattaacaactattgcatcagctgtcatgttaagtcttgcttttagtggtgtagcaatggcaaaagagacaattgcattagcggtgtcaactttagataacccattctttgtgtcacttaaagacggagcacagaaaaaagcggatgaattaggttataaattagtcgtgttagattcgcaaaatgatcctgcgaaagaactggctaatgttgaagatttaatggttcgtggtgcaaaagtattattgatcaacccgacagacagcgaagcggtttcaaatgcggttgctattgccaatcatcgtaatgttcctgtcattaccctagatcgtggagcggcaaaaggtaaggtagtgagccatatcgcttcagataacgtagctggcggtaaaatggcaggtgactttattgcacagaaattgggtgcaaatgcaaaagttattcaacttgaaggtattgcgggtacatctgctgcacgtgagcgtggtgaaggtttcaaacaagctattgcagaacacaaatttgacgtattagccagtcagccggccgatttcgatcgtactaaaggcttaaacgttatggaaaatttattagcaagtaaatccgcagttcaagctgtatttgcacaaaatgatgaaatggcattgggagcgttacgtgctattaatgcggctaataaaaaagtactggtagtcggttttgatggcactgatgatggtgttaaagctgttaaaagcggtaaattaggtgcaactattgcacaacaaccggaacttatcggtagtttaggcgttgaaactgctgataaggtattgaaaggtgaaaccgtcgcagagaaaattcctgttgacttaaaagtcattgttaaataataaagtgagggcatatttattgtcctcatttcttgatataaacaataagggcgattttgtttattttctgataaggataaatgatgagtaaaactcttactgttcttggtagtattaatgcggatcatgttatttctgtaccgcactttgccaaaccgggcgaaacactaagcggtaaacaatatcatattgcttatggcggaaaaggtgcaaatcaagctgtggcagcagcaagattagcggattttagccaaggtgcaacagtgaattttgttggttgtattggtagtgatgatattgggcgagcgatgaaaaaagcgtttgcacaagatggtattaatgttgcgacaattactgaaattcctaatgaaatgactggaattgcaatgattcaagtggctgatagcggagaaaacagtattgtcatttctgccggtgcaaatgcatatttaacgcctgagattgtagataaatttgcgacagaaattgagcgggcggattatttactcatgcaattggaaacaccgttgaacgcaattttggaagcagctaaattagctaagaaacatggtgcgacagtcgtattaaatcctgctcctgcgagccaattacctgatgaattgctcagtttattagatatgattacgccgaatgaaacagaaacggaaattttaaccggtgtgaaggtaaccgacgagcaaagtgcagcgaaagcagcgagtgttttgcatcaaaaaggtgttgctactgtgttgattacgttaggttcaaaaggtgtttatgtgagtcggaaatcttcgacacaagaactggggcagaataaggttatagccggattcagagtaaatgctgtagatacaactgcagccggtgatacgtttaatggggcatttttgaccgcacttttagaaaataaatctcttgacgaagctattcgttttgcacatgcggcggcagcgattagtgtgacgcgtcaaggggcacaaccttccattccaactcgtcgagaaacattagactttttggcacaacattaattaatgtaagggcgttgaagatggctacaatgaaagatattgctcgaattgcacaggtatcaacgtccactgtttctcatgtgattaataattcacgttttgtcagtgaagaaattcggcagaaagtcatggcggtagtggagcaactgaattatacgccctcagcattggctcgcagtttgaaagtcaaagaaactaaaacaatcggcatgctggtaactacgagtgataatcctttttttgctgaggttgtggcgagtgttgaacgttattgtcgccaacatcattatcatttgatcttatgcaataccaatgatgacagtatttgtttgcaagaaaatctgcaaaatttgatacgcaagcaggtcgatggattgctcttgatgtgtacggatagtgcctttgaaaccagtcctttaaatttaactgttcctactgtcatcatggattggtggccgacagagctaagtgcggataaaatttttgaggattccgagctgggcggatatttggcgacacggactcttattgagcatcaacatcatgatattgcgattattacgggaaatctgaaaaagcctcttgctcgtaatcgtttgaaaggctataagcaagcgttgcaagaatacaacattcctattcgtgataaatggattattgaaagtcattttaactttgaaggcggaattaagggaatggaacagttgttacaattgaaacagcgtccaagtgcggtgtttgcttgtagtgataccattgcagtgggtgcttatcaagctgtttggcgtcatgggttatctgtgcctgaagatatttccattattggttacgataatattcatttagcacaatatctttctcctccactaagcaccgttcatcaacctaaagatgaattcgcacacttggcagtagatacattgttgcaacgaataaaaaatcctaccgaaaattaccgcacgttgacgttaaaacctgagatagtattgcgtcaatctatttgttcctgttttttgcctaagtccgcatagaaaaaagaccgcaagtgcggtctattatttatctccaaaatttccaccagcttgtgcgttttgcttccggaccttgaatgattgtattattgatatattctttttcaacatcaggtagcggtttatctaaattaacgtcggtgacaataccgcgtcgatcaaaattcacaataaaagtatgttgctcaggtgcattataagatttttgttgtaaaaatacgtagtaccaagtttgattgctaaatggatctattagcattggcgtaccaagtaagtactgaacttgttgtgcattcatgcccactttcacttgttctacagcggtagattctaaatagtttccttgtggaacatcaatacgataaacgattttttgaacactggaacaagcggtaacgcttaatcctaaaatcatagcaggaataataaattttaatcgcatattttgtttaccttaactcgtgcaaataacgtcgtggataataactaaaattcgtaaaattgccaacttattcttttgtttggcgttgtagttgatcgcgtaaattcggcggtagtcctgtaatggttaaactatccgttgcttcatcccaaaatatacgactgtttaataactcggcatcaaaacttaatgtgataccttttcctgagccggaaaatttagtcagcgattttaatgcagtacgtacgggaggaatattttcttccaagccataattttggctgacagcgaaatcaacaaaagactgttcatttagagtgggtatattggcagaaagttccctgacaacgatttcttcgcctacatttatttgtcctttacaataatcgaatacttgttttttgaccgcttgagtttgttcttttgtcaaatccgcctgttggcagtagtcactaactgcttgtaataaacattgattttgcacttgaggatttaatccctcttctgcacctaaaaaatccataaaaaagtcagcaattttgcgtccaactcgacctttaataaaagtcagataacgagttgattttgcatctaaatgcaattcggttaaattaattcggcaagcaatatcaaattgagtaatatcaagataatgcgtttgttttatttccagattttcatcaaccaacatactatagcgactatctaataatgcgatgaataaataatctgttgcgagaaaattgtattgacacaaaattaacgtgccatcattggcaaaactgtattttcctagctcttgacgtaataattcggctgattgatgactaaatgccaagaaatcaatatcgttttccaatgtgcggttgagtatttgagcaaaatttgaggtttcttggaatactccataggcttttgttttattttgatactcttgatgtaattgcaacatcatttgttctgtttccgctgtaattggtaataattcatcacgtaaatgcgttttaagttgaacggtattttcatcttgtgatgttttaaccaattgatgcaaaacaatttgattgactataatgctcattttgttcaaatcctgtttatgataaaaattcttaatattataaccgcactttaaggaaaatatgctagtatgtgtccaaattattcgtttctatttatatttagcgtacaaaattaaatggcaaaaatttcaaaatttcaagataaacaagttgaggcaatattgaatgatatgatcgctatactggaaaagcatcaagctccggtagatctttctttagtcgtattgggcaatatggtaacccatttgttaaacagtagtgttgggtcgcaacaacgtattgtgttggcaaaagtattttccgatgctttaatgaattcagtaaaaaatagtaaataatatgtttggaattaaaacaagcaagcaatatcgtgatgaattatcttgtaagattacgtggggacattggtttgctttttttaatattttgtgggcaattgttattggtagtcgttatgcctttattattgattggccgcatactttattcggtaaaatatatttttttattagtttattggggcatttcagcttcattgtttttgctctctatttgctcgctctctttcctctcagttttattataaaaaatgaacgcacttttcgtggtataagcgttattttaacaacgataggtgcaaccttactgttggttgatacagaggtgttttctcgttttaatttacatctttcaaccctcgtttggaatttgttggttaatcctgatgatggtaagttatcttataagtggcaaatattttttgcacctatgccattgattttatttgttcaaatgcttttctcacgttgggcatggtataaattacgcagtttagagagacaaaaatggattaaaggtgttgctcttgtatttgttgttagctttattgctacacatattctttatgcttgggcagatgcgtatatttatcgcccgattaccatgcaaaaatcgaatttccctctatcttatccaatgacagcacgttcatttctcgaaaaacatggtttcttaaataagtctgaatatgaaaaaaccttaaatgagcaaggtcgtcttgatgcgttaaaagtgaattatccaaagcagaaattgactttttccgatgagttgccaaagacgaatattgtccttatcactattagtggattacgccatgatgcagttcgacaggatataatgcctaatttatttgcattttctgagaattcaactgaatttactcatcattacagttcaggaaactctcttaatcaaggtttgacaggattgttttatggattgaatgctaattatgcggacagcttacttagcaataaaacaacacctgtattaattgagcagctaaaacaaggaaaagtgcggtatgaaatcggtctatttggtcagaatttatctcgaagtgtattattgaagaaaagtatttttgcacatgagaaaataagaaatgacaacaatgcctctacgtggcgttttattgagtttgttaatactcgacaacaacagcaaaaattattttttgcctatctaaattattcactgaacagcaatttgactattgaacaatattatcaaaagttatctgaaattgatgatgagattggttcggcatttaagtcgatagattttactcataccattgtgatagtgacttccgaatatggttatagttttgatttttctgataaaaaaagaccaactaattattttgcaagagaagtaattcaagttccaatgattataagatgggaaaatttaccgatcggtaaagtgaataaattgagtagtcataccgatttggtcccagccttaatgaaacatatttttaaagtaaaaaatccaattagcgatttttctcaggggcaggatttatttgatttggatgataatcgtagttgggttcttgctggtaattaccggtggaatgtaatcattacaccggatgattcgcaatatcatattgataggaatgggcattatcaaaaatacaatcaacattatcaaaaaatttcgtcaacacaacctccgttaggattattcttggaagtattttcacagaatacggctttcatcgaaaaatagatttattagagataagccgttttccgagatgagaatgctaagagtggaagcgtattctgttttataaaaaaaagcgtttcttttgtgggggaagaaacgctgaaatgttggagtgattatctattattgtttgagtgatatagatgataattgttctcaaataacttgtcaataaataaataaaaattattatcaattttttttcttgtctttaattattctaggtaactcactaaatttgttagataaagtgcggttggtttttgatgagaaaaatcaaatttcacggcatagctataaacttcaacaccttctttaactgcttgctgcagtaattcggcataaacaggatcaatagattttgcaacagtgaagcgattaaaaccgtcgtgaagaccggcgaaaaaaacgaccgctctatgtccccgctttttcattgctataagctcacgcaagtgtttttgtcctcttgttgtgacggcatcagggaaaaaaccgagatgatttttgacaaacgtaacggattttacttcgacataacaatccggtaagtttttaccgttgagtaaaaaatcaatgcgactactttctacaccatattttacttcaggcaaaatctcatcatattcagctaattctgtgatgattttattttgcaaagcctctaaagttaattgattggaacggtgagtattgatacataccgtttgaccatttttaagttgagttaattcccaagagtgcgggtattttcttgttttgctgtcagaagtagaaaaccaaacagtatcgcctttttcaccacatcctgtcatcgcaccggtattggcacaatgaagtgttaaaatttcaccgttgtttaattctacatctgccaaaaagcgtttataacggcgaagtaatgttgctgattgtaaatttggtaattgcataaaaatccttgttatccaacagtttcagtaattttaccagctttatctgaaaaaaatttggattgaagcaatagttgaaatttttaagaaaatagctttatttttagcgaattaatggtacatttactccgcttgactttttgtcatcttaaaggatgggcgatattatctcccaatttttttaatcaatcaatttgaaggaaacattatgttaattggtgtacctagagaactgcttgataatgaaagtcgtgtggcggcaacgccaaaaacggttcaacaaattttgaaacttggttttgaagtgattgttgagaacaatgccggttttaatgcgagttttgaagatcaggcgtttgtaaatgcaggcgcaaaaattggttcggcacaagatatttggaatgcggatattatttttaaagtaaatgcaccgacagatgctgaaattgcacaaattaaagaaggtgcaacgcttattagctttatttggcctgctcaaaattcagagctaatggcaaaactttctgctaagaaaattaatgtgttagcaatggatgctgtgcctcgcatttctcgtgctcaagccttagatgcgttaagttcaatggcaaatatttccgggtatcgtgctgttattgaagctgcacatgaatttggtagctttttcacagggcaaattacagctgcaggtaaagtacctcctgcgaaagtacttgttattggtgcaggggttgcagggcttgcagcaatcggtgcggctaatagtttaggtgcgattgttcgtgcatttgattcccgtccggaagtaaaagaacaagtgaaatcaatgggagcggacttccttgaaatagatttccaagaagagggcggtagcggtgacggttacgcaaaagtcatgtcagaagaatttaaccgtcgagcgatggcactttatgcggaacaagcaaaagaagtggatattattattaccacagcagcgattccgggtaaaccggcaccacgcttgattactaaagaaatggtggattccatgaaaccgggtagtgtgattgtggatcttgctgcactgacaggcggaaattgtgattatacgaaagccggtgaaattgtggtaactgaaaatcaggtgaaagtcattggatatacagattttccaagtcgcttaccgacgcaatcctctcaactttacggcacaaacttggttaatttattaaaacttttatgcaaagaaaaagatggcaatatccatattgacttcgaagatgtggtattgcgtggtgtaaccgtaattcgtgatggcgaggttacttggccggctccgccgattcaagtgtctgcacaaactcaacaaacaacaaccgcacctgttgtggataaaaaagaaaaaacgccaataaatcctaaagtgaaatatggggtaatggcattggcgggagccgctttcctatggctcggttctgttatgccggctgcatttttatcacactttactgtattcgtattggcttgtgtggtcggatattacgttgtatggaatgtaagccatgcattacatacaccattaatggcagttactaatgcgatttcaggcattatcattgtaggagcattattgcaaattgcacaaggaaatttctttatcagtttgttggcgttcattgctattttggttgcggcaattaatatttttggtggctttaaagtgactcaacgtatgcttgccatgtttagaaaaggttaaggagaggatgcaatgtctgaaggtttagtacaggctgcctatattgttgcagcattactgttcattatgagtttagcaggtctttctaaacatgaaactgctaaagctggttgtttgtatggcattgttggtatggcaattgcacttgttgctaccatttttggaccatattcacaaggattattctggattattattgcaatggcagtcggagccgtcattggtattcaacgtgcaatgaaggttgaaatgaccgaaatgccggaattggttgcaattttacatagttttgttggtttggctgccgtattggtgggctttaatagttttggtttacatgaaaccgcacaatttctggtaccggaaggtgttgaatatgtcacggatgctgctcaagcattattagcacaacaaaaagcggactttgttgcggaacaatctgtattggcaactattcacaatgttgaggtctttttaggtatcttcattggtgcggtaacatttaccggttctattgtcgcattcggtaaattacgcggtattattaattctaaagcgttaatgttgcctcatcgccataaattgaatttggcggcattgattatttctgcgttgttgatggtcgcatttttaaattcacctgataatatcttccctgtattactaatgacagcgattgcacttgcatttggttggcatcttgttgcttcaataggcggtgcagatatgccggttgtcgtatccatgttgaactcttattcaggttgggcggctgcagcggcaggcttcatgttaaataatgatttgctcatcgttaccggtgcattagtaggttcatcaggggcaattttgtcatacattatgtgtaaagcaatgaaccgctcttttatcagtgtcattgccggtggattcggtaatgatgtagttgcttcatcagaggcagaacaaggtgaacatcgtgaaacaacagccgaagaagtggcggaaatgttgaaaaatgcaagctctgttattattacaccaggatatggtatggcagtggctcaagcacaatatccggttgcggaaattacagcaaaattgcgtgaacgtggtgtgaatgttcgctttggtattcaccctgtagccggaagattaccagggcatatgaacgtattgcttgcagaagcgaaagtgccttatgatgttgtacttgaaatggatgaaatcaatgaagattttgcggataccgatgtcgtattagtcattggtgcaaatgacacggtaaatccggcagcaatggatgatccgaacagtccaattgcgggcatgcctgttctagaagtttggaaagcggctaatgttgtcgtattcaaacgctctatggcggtaggatatgctggtgtacaaaatccgttgttctttaaagaaaatacccaaatgctttttggtgatgcaaaagagcgagtagaagatattttgaaagcgttataacaagagaaaaactggtatagaatataactgcactttgctaaaataaagtgcagttatttttttacatttaggaatatgttatggtgcaatatgccttgctcattttgtttagccttgcttcaataatttttattattaactcccattatcgttggacatatttttttgcaataagtcaatttttgttatttattggcattatgtttactattacagggcaatggcaaagagcggttaatttttcttctacattattcattgtttttgtgttgtttcatcgaattaaaatccatttttataagcaaccgcttttgatttcagatttctttttagtcatagattggcgaaattgggaaaccttgttgcattatcgtcaggctttttttgctattatggggctattggttttgttggcttatggtatattcggttggcaaaatacccccgctcttcctttttattggcagataatatcaggcttaatttctattattttaattgtttcaatttgtcattgtacaaagaacaagcaagctatcaagcaatggttagattctttacctgatgatggaagagatgtatttcttaatttacctatgtcctgtcgaggaatcttttataaatcgccggtattttctggaggtagtcaatattttcttgaaaaagcagaatcaattgaaagccataaacaatcaaattcggagcaaaaagcagatattgtagtttggttacaagaatcaacgttaaatccgcatagttttctttttaaacagcacaatattccacctatcacaatgtatgaaaatcaagatgatacaaaatgtaattctcatctgcgagtacataccttaggtggtgcaacttggaaatcagaatttgcatttttatcaggattgccctcaacagattttggtgcaatggctaatgcagtattttattctgtcgttcctcatctaaaatacagttttgttaaaaatttaaaagcacaaggatattattgtgttgctctatctccttttactaaaggaaactataatgcgaaatctgcctatgatcattttggttttgatttaatgttacaaccgcaagatttgggttatccggctcccttaagtaagaatttatggacaatcggtagtgatgaaatgagtcagtatgttcagaaaattcttgataaaaaagatgtgcctcaactaaaagatttacaaaaacccttatttgtttatgtattaacaatgcgtgaacatggtccttattacaactgcggtaatatttttcaaattcaaatggattgtgcaacggagcgagggatcggggaattaaatgattatattcaacggattgtaaatttgaatcaagttatggaagattttaatctttatatgcaacggagaaataagccttatattttaggttattttggcgatcatcaaatttcaataaaagaagctgtaccaagttacagttttaattatccttatccggaatatatcacgcaatttgcggttcgcagtaatttagaaacggattttgaaaagcacgattttttagatttagcatttatagcaggagctattttagaaatagcgggattgcctgtcgatgaatttatgcaaacaaatattaaaatgagaaaattaagtggaggtaagttacaggactgtactgatcaacaattattagagtcttatcgccattatatttattcagaattaaaagtagcggagtagttcattatgaatatgttgcctaattaaaggcgttgctattaaaaggtgtaatgaaaaatggttgctaataatatctttctgaagttattagcaactctttttatttaaaagtccttattgacgtcctcccctagctaaagcaaggagattcctaccagctcccattgcaagcaatgggctactctcggtggtttctgctgctgaccgccaatgcgattcacttcacagacgctacaggcatgtcctgccctgattatgccgtcattgagagtctaaagcgacctctgttagcagtaagaagtatatcatatttgtgccttatatctacgccctaaaggacgtggttttacggcactgtctgataaaaactattttttcttcgcatatttcaaggaatcaattgcaacggcaaagataataattgaacctttgataatatattgccaatatggatttacaccaatataggttaaaccatagttgatgacagtaaaaattaatacaccggttactacgcctagtacagtaccaacaccgcctgcaaaagatacaccgcctacaacgcaagctgcaatggcatcaagttcatacataaaacctagattgttggtggcagaaccgatacgtcccgcttctaacatccccccgaaagcgtagaatatacctgcaatcatgtaaatgacgacaaggttacgagtaacgttaacacccgatacttttgctgcttccggattaccaccgatagcgaaaatgtttttaccgaaacgtgttttattccatagtacccatacaaagaaagaagccaaagctgcatagattgtaatataggaaagcttgaaagaacctatacggaaaaagccttgagcaaatgtagagaaactttcgttgaaccctgcaataggtgaagaaccgacagcatcataatagagagagttaataccgtaaacgataatcatcgttcccatcgtggcgatgaaaggtgtgacatttaagaacgcaattacaaccccatttaccaatccaattattgccccaatcatacagactactatgattacaacaggaataggaatttcaccaagttcagggaaaactctatttatattatccattgcttgtaacagagttgccgaaataactgcagctagaccgacttgacgacccgctgacaagtctgttccttgtgtaactaataaacctgcaacgcctaaggcaataattaagcgaacggaggattgcgttaaaatattactaaagtttcttaaacttaagaaacttgagtcttgcataataataattccgagtaagatcaataacacaaaataaattgcgttttgtttaaggaaatctagcgatttgttttgttttaaagcagacataattcatttccttcctttaaagatattttgccgcaagttgtaaaatttcttcttgcgatgtttttgctgtttcaacaatttcagtaacttttccgttactcataactaaaatacggtctgtcactcccaataattccggcatttctgaggaaattagaatgatccctttatctttttttgccaattccatgattagctgataaatctcgtattttgcaccaatatcaatgcctcgggtcggttcatcaagcatcaaaatttcaggttgtgtgagcaaccaacgcccaataattactttttgctgatttcctccagaaagtgagccaatatgggtttgatgtgaaggggttttgacattcattgcatcaataacccattgggtatcacttttcattttaatggactttaataaaccaaaatgacctaaataggatttcatattagaaatgagagagttaaattctatgctcagatttgcataaatacctgttgagcgacgttcttcggtaacgagagcaaatccattattaatcgcctcaagtgcggtgcgatttttcatttctttgttatacaatttaattgttccacttttacgctcacgaataccgaaaatggtttctacaatatccgtacgtttggcaccaacaagtccagcaataccaagaatttcacctttacgcaattcaaaagaaacatcttgaatggagggttgatttaatgctgtcagatttttgacttcgagaataacttctttgggttgatttgttttaggggggaagcgttgagttagttctcttcccaccatcatggaaactatttcatccatggtagttttttgtacttcaacagtattaatccatttaccgtcacgcaaaattgtgatttcatcacaaattttgaaaatttcatccattttgtgtgaaatataaacgattccacagccacgtttttttagttttgcaatgattttgaataaatgttcaacttctttttctgaaagtgaggaggttggttcatccataatcacaattttggcattgtaggaaaaggcttttgcaatttcaaccatctgcatttgtgatacagataaattcgctactttctctttgggatcaatatcaatacctaactcatcaaaaatagcttttgtatctcgatacatttttccgtgatcaacaaaaatgcctttcaatggataacgtcctagccataggttatccatcacattacgttgacgcaccaaatttaattcttggtgaaccatggatataccgttttccaacgcctcttttgaggttttgaaattaattggcttgtttaaaaaaagaatatcgccttcatctttagcataaataccgaataagcatttcaacagtgttgatttacctgctccattttctcccattaacgcatggactgagtgagatcgaattgttaaattcgctttatcaagtgcttttacgccgggaaaggatttactgacatttatcattgtaagcaatatttcgctactttgatgtagagtttgtcctgtcatatccaacctcatagaaaaggggagtacatatctcccctaatgattacaacaattattttaagaattcatttaagttgtctttatcaatgccgacataaggaatacgaacaacacgtttttctaatttccagtttgttccttctgttgcaggtttaccttgtgctaaattttttgcaagttgaaccactgctttaccttggttaacaccatcatttagtacggtacctgccatttcaccttttttaattaactgtaatacttccggcaaggcatcgacaccgaaaatcgggagttttttaccatgggctttagttgcttccaatgcacccattgccataccgtcattattagaaataataacctcaatttcgtttgctttagagctggataaccaagcatccactttatcttttgccattgcagcatcccacataccagtatcaatgaacaattgttctgattgaataccctgagcattgagtgcttcaattacgtatttggtacgagcttcagcatccggatgccccggttcacctttcaataagacatattgaattttcccatctttatttaagtcataggctggatttgctttccaatgtttcgcaattaaattaccttgaatgagtccggattctttaggatccgtaccgacatagtaagcgtggttatagcttccaattgcttttgctccgggatctttattgaagaagataaccggaatatcctccgattttgcttttttaatgacagttggtgcagcagcagggtcaacaaggtttattgctaatgttttaacgcccttggaaattaatacatcaacctgatcattttgaacagattgtgcattttgtgaatcattcattaacaactctaatccacctacagcttttgcttctttatcgatttcttgacgcattaacgccataaaattatcgtcgtatttgtaaatggttacaccgatacgatcagctgattgtgctgagattgcactaaaacctacagctaaagttaccgcacttaatattgtttttttcataaaatgctccttgattggactggaaaatagatattcttatcgatacttagcctatggtttggcaagccacgacaaggatagccgaaaatgtgtgacaagactgtgatctgtttcacatttatagaaatttatgaaaacgatttcataaaataggaaaattaaggacgttcaactgaaaagcgtcgaactaaagttggattaaattggatatgaacaggttcatcaatttgattgtctactagacttagtgcgagttttgccgcataagttgccattaaatcaataggatagcgtacagtagtcaacttaggaattaaatagcgtgaaatgggcatatcatcaaatccaataatagagaattgtttaggaacttgtatattattttcgttcaatacggaaatagcaccagcagccatactgtcgttatacgcaataactgcggttaaatttgagttataactcaataaattaatcatggctttttcacctccttcaaaatcaggtgtgctacgtgcaattgcatgttcaacagcgtgaagtttatgatgttctaatgctttcaaatagccattaaaacgatcattttcatctgtaatttgatgatttgagccaatataaccaatatgctgatgcccaaatttgatcagcatttctgtagctagaaaggtacctttattattgtctaaacttacacaacgagtttcataaccttgaatgacacggttgatgattaccataccggaaatacgttctaaatattgagcaagctcttgatcacttaaagcttttgaatgaacaactgcatcgtttgcacaataaggtgtctattgcatttctttctttttccgcattgtgatagccaatgccgattaagatacttttttcatgttcttccgcaacgttatctacggctttaactaaaattgcaaagaaaggatcggttacatcagtaacaacaacgccgatagtatctgtatgttgtaaggcaagagcttgagcattggcatttggatgataatttaatttttcgaccgcactttgaaccgctaggcgtgcttttttactggcagaaggatgattattgagtacccgagaaactgtcgcaacagaaactcccgcttgtctagctacgtcatgaattgtaatcatcttattcacccatacggtttaaaatttgcatgaattgccacttatcataaccaaataaattatgtttggaaacggttgttaaactaaaataaaagcgacttcacaaaattattatttatctcaatatttataatttaataattgtgatatggatcacagttaaacaaaatagcgatgtgatagcatagctgaaaattatttgtaatcgtttacatttttgcgataaatatcaagtttgagggtataaaagtgagtgaaatgaccgaatttgttgcgacagaacatccgcatcgtcgttataatcctttgacggaacaatgggttttagtctctccgcatcgagctaagcgaccttggcagggacaacaggaaaaaatagctgatgaaaataaaccttgttacgatcctgcttgttatctttgtccggggaataagcgtattacaggtgagcaaaatccgaattatacgaaaccttttgtgtttaaaaatgatttttccgctttattagaagatacgcctgaaccactaaaaacggatgaccctttatttcaatccagtctagcacgtggcgaaagcagggtagtttgtttttctccggatcatagtaagacgttgccgttattaacggtagaggaaatttttgcagtggtaaaagtttggcaagaacagctggaggagcttggtaaaaaatatcaatgggtacaaatttttgagaataaaggtgcggttatgggctgctctaatccgcatccacatggacaaatttgggcaaatagttttttgcctaatgaagttgctcggacagacaaggcacaacgaaattacttcaataaacaaggttcgattttgttaatggattaccaaaaacgtgaacgagatttgcaggaaagagtagtaattgaaacggaatattgggttgcagttgtgccttattgggcggtttggccatttgaaatattgttactacccaaaattcacgtgaagcgattaattgatctgaatgagacgcaggcaaaggatcttgccttggcattaaaaatgatcacaaccaaatatgataatttgtttgaaacttcttttccttattctatggggttccattttgcaccttttaatggtgaaaagaatgaacattggcaacttcatgcacatttttatccaccgctactccgttcggcaacggtgcgtaaatttatggtcggttatgaaatgttaggggaaagtcagcgagatttaaccgctgaacaggctgcagcaaggttgcgtgaattaagcgatgttcattataaaaataaataaatttaacggagtgataatatgactcaacaaaatccaaaacagcgagcgaaacagttatttagtgaaaaatttaaccgcacttctgaactgaatgtctatgcccccggacgagtaaatattattggtgaacacacggattataatgatggatttgtgatgccttgtgcaattaattatggaacggcgatcagcggagcaaaacgagatgattatttattttgtgtatatgcggcagatttacaagaatatgatgaatttgatttaactcgacctattgaacccaaaatggaagctaaatggacaggttatgttcgaggtatggtgaaatttattcaacaacattgccctgattttcaacaaggtgcggatttggttatttgtggaaatgtgccactttctgccggattaagttcttctgcatctttagaaattgctgtaggtaaattttgtcagcaactagcggacttatctttaacaaatatagaaattgcattaataggtcagcaggcagagaataaatttgtaggtgcaaattgtggaaatatggatcaattaatttccgcattgggtcaaaaagatcattttctcatgattgactgtcgatctttagatattgttaccatacctgttcctgaaaatattgttgtgatgattgtgaattctcatgtgaaacatgatttagtaaatggcgaatataatatacgccgtcgacaatgtgaaatggcagcccaattttttggcgtgaaagccttacgtgatgtatctgtggagttgttcaaacaaaaggaagcagaattaaccgctcttgatcctgaaatagcgaaacgtgccaaacatgttgtgacggaaaatgagcgggttttacaatcagttcaggccttacaacagggagatttgcaaaaattaggggaattaatgtatcaatctcatgattccatgcgtgatgattttgaaattactgtgcctgaaattgattatttagtggagttggcacaggtcgttatcggcaaaaatggtggagcacgcatgaccggcggaggttttggcggttgtatcgtcgctattgcaccgcaagacaaagtggaggcagtacgtcaaattattgcagacaactatgaaaaacaaacaggtttgaaagaagatttttatgtttgtaccgcttctaaaggagtgacgatatgctaattgattgttttgagaaggaacacaagcaaggaatggcaccggatggacaaccttttcgtatttttacgttaactaatacaaaaggcatgaaagtgcaagtgatggattggggggcaacttggatttcttgtcaagtaccggtaggaaaagaagtacgagaagttttgcttgggtgtcagattaatgattatccgatacaacaggtttatttaggagcgagtattgggcgttatgcaaatcgtattgcaaatagccgatttgagttgaatggtaaacgctatttacttaacgctaatcaacatcagcatcaacttcatggtggaaaagggtttcataatgagcgttggtatttagaaaagtgcggtgtaaattccatcactttttctcattttagccctgatggagatcagggatttcccggtaatttacatgcttttgttacttattctttaagtgaaaccaacaacgtgagaattgaatatgaggcaatttgtgatcaagattgcccaattaatttgactaaccatgcttattttaacttgaatgatgctactttcggttgtgatattcgagggcattctttacaacttaatagcgattattttttgccggtggacagtgcgggtattcctaatgctaagttaaaagcggttgagggaactagttttgattttcgtgaggaaaaaccgatcggtttagattttttacaagaagaacaaaaattggtaaaaggttacgaccattctttcttgcttaatccggacactgaaaaaccttgtgctattttgaccgcacttgatcgttctttgagaatgcaagtgttgacttctcagccggctttacagatttatacgggcaattttctatcagctacgccaactcgtcaaaacgggcagtatgctgattatgctggtattgctttggaaactcaatgtttgcctgatacaccgaatcatccggaatggtggaaatatggtggaataacaaaggtgggtgaaaaatattctcataaaacggaatatcaatttatccgttagatttttaagcaaactctattgaaattaagggggagtattcaaaaaactcccttatttttttctatttctcgcttatatttttgttatgtcatacttttcctgatttttcctagttattcgttacaaaatatgataattttcatgggtcaataagacggaaacaatattacagtttatgagtaacgacgaacagattaatacaatcacagaaaatgaaagtaagaaaaatttctttcactctttatttggacgcttttttcagggtgaattgaaaaatcgtcaagaattagtagacgttatccgagattctgaacaaaatgagctcattgatcaaaatacacgtgaaatgattgaaggtgttatcgaaatctcagaattaagagttcgagatattatgatcccacgttcacagattatttttatcgaaaatgatcaggatcttgaagcgtgtcttgatgttattattgcaagtgcacattctcgtttcccggttatcagtgatgagagagataatattgccggtattttacatgcaaaagatttacttaaattttttcggtctaatgcggagcaattcgaattacaaagtttattacgacctgccgttattgtaccggaaagtaagcgtgtggatcgaatgttaaaagattttcgtgctgaacgttttcatatggcactagttgttgatgaattcggtgcgatttcaggtttagttaccatagaagatattttggaacaaatagtgggggatattgaagatgaatttgatgaggaagatgtggcggatattcgtcagttgtctcgtcatacttatgtagtacgagctttgacggatattgatgattttaatgagcaatttaagaccaattttgccgatgaagaagtggatactatcggaggtttgattatgcaagcattcggctatttaccgaaacgtggtgaagaagttgtactggataatttgaattttaaagttacttcggcagatagtcgtcgtattattcaagtacgagttactgtgccggatgagcaacttacagacagtaaaaaacagaatacagaagaatgagaaattaccttgtttatttcattgctattttaactgggggagtgggcgtattagccttttccccttttgatctttgggcaatcgcctatctttcattagcagggttgatttggattgctaaaaaatcgcaaaaaaagaccgcacttctagccagttttttatggggtttaagtttctttgggattggcgttaattggctcaatgtcagtatttatcaatttggcggaacaccgttaattgtgagctatttactggtcattttactggcaggatatttggcactttatcctgtgttgtttacttatttagtacaacgttttagggtacaaagtttagcgatatttcctgcaatttggacattgactgaatccttacgcagttgggtatttactggttttccttggctacaatttggctatactcaacttgacagcccatttgcgaacttagccgctttgttcggtgtagaagggctgacttttttcgtgatgtggataagtgcggtcatttttagtcttatttctcagctcatacaatcaaagaaacaatgggcaattattattacacatagtgtattgcttgttgtgatgttagggctaagtgcatccactgcgttacttaaatttacacaagaaaatccacaaaaatccctaaatgttactttagtgcaaggaaatattgaacagcaactaaaatgggatcctgattatttttatcaaacactcactatttaccaacgcttaattaaccggagtttagatgactcagatttaattatattgccggaagctgccttgccggccttggaaaatcacattcaaccttatttgcaaaccttacagcaacttgctcaagaaaaaggcgttgaggttgtaattggaacgatttatcaagaggaaagtgaggataaattattaaattctatcgtaaatctcggtaacgctgatgaaccttatcatctaaacacaaaaaaccgttatgcaaaacaccatttagttccttttggagaatatgtccctttagacaaaatattacgcccgttaggttcagtttttaacttgcctatgtcaagttttgcgtcaggagactttgtccaaaaaccatttttagcgaaaaatcgccattttactccggcaatttgctatgaaattatttttggttctcaactacaacaaaatttaactaagcaaagtgattttattttaactatctcaaatgatgcttggtttggcgatagtataggcccttggcaacacttgcaaatggcaagaatgagggcgattgaactgggaagacctgttattcgtgcaactaatactggtattacagcctttattgatgcacaaggtaaaatagttgcacaagctccgcaatttactgaaacgacactgagacataaaatcgttgcaacggaaggtatgactccctatgcaatattaggaactaagccgttgtatttgttaatcagtttattagtattatttagaagtctaggtgcattgatacgcaaaaaattgacgcaaggatagaaaaatattattttgcgaacaggttacagctatttttccagattgtagatgcgataagttctgccggttcttttcttaattgacataattcatggaaaacatgaataattcgctctgaacgattgggttgaccttgaaaaccacaaatgggcatatcgggactatccgtttccagtaataaactgtctaaaggtaattttgcaatagtgtttctggttttattggcacgttcataggtgattgtgccgccaacaccgattttatagcctaaatccacaaaacgctttgcttgatcataacttccggcaaaaccatgaattacaccgcacttatttacttttattcgtttcagaaaagtgaataagtggtcgtgagattggcgactgtgcaagctgacaggcaaattaaagcgttgtgcaaaactgagttgaacttctagaaattcacattgctttttccataatttctcgctaatcagatccgattttcctcgttccagacctatttcagcaattgctgtacaagcagcagaaccttgttctaacgcttgggacaaaatatctaaatcatttttactatgctgttcaatatataaaggatgtaagcctaatccataatacagctgagtcgggtaaagtgcggtcatgtttacaatattttcaaaatctcgctgcaatactgctacaatcagtattttctctacatcaacttggcgggcattatgtacgagttgagccaaattttcctgagtaacttgctgtacataatctaggtgtgtatgggtatcgaaaaaatgcataatgatttgatgctggcaatttgaggaacaatattggctacattacgacgaaatccttgatcgactttttgttgaatgatcaaggaaatcgttatctacaagatgggtaaaaattgtaatatgcttgaatgtaacaccgcactttttgatgaaaatgtaccgacaatatttgtcggtccactatcaaaaatattattcaatggtaacagaagtaataattacatcttcaacaggcacatcttgatggaaacttttgtttcctgttttgacacctttaattttatcgacaatatccattccttcaacgacttcaccaaatacagcatagccccattcttgcacaacggttttaccaaacatttcttttgctcgataatcaaggaatgtgttgtctgctacattgatgaaaaattgagctgtcgccgaatgaggatccgatgttcttgccatggcaattgtgccacgtttattgctaagtccattacttgcttcgtttttaattggtgctttagtatttttttcacgcaagccactttccataccaccaccttggatcataaatccatcaataacacggtggaaaattgtgttattatagaacccctctttgcaatatgttagaaagttttccgctgtaattggtgctttttcaaaatttaatgctaatttaatatcaccaaaatttgtgtgtaatgtaatcattttagatcctttgattttgtgttgttataatgatgcttattatttcataaagttgcaataagtgctataaaatcatcactgagcggattcagcgttctggtagattaacgatttcatttaattatagagaacaaacaaatgttaaaaatttttaataccttaacacgagaaaaagaagtgtttaaacctatttcagaaaataaagtaggaatgtatgtctgtggtgtaactgtatatgatttgtgtcatattggacatggacgcacttttgtttgttttgatgttatcgctcgttatttacgttatttaggttatgaattgacttatgtgcgtaatattaccgatgttgatgacaaaattattcgccgctctttagaaaatagagaaacttgcgagcaattggtagatcgtatggttgttgaaatgtataaggattttgatgcgttgaatgtattacgtccggattttgagcctagagcaacacaccatattgcagaaattattgcactggttgaaaaattaattgcacgtggtcatgcttatgtggcggataatggtgacgttatgtttgacgtggaaagtttcaaagagtatggcaaattatctcgtcaagatttaacacaattgcaagcgggagcaagggttgaaatttctgaaattaagaaaaatccaatggatttcgtgttatggaagatgtcgaaagaaaacgaacccagctggaattcgccatggggagccggtcgccccggttggcatatagaatgttccgcaatgaattgtaaacacttaggtgagcattttgatattcatggtggtggatctgacttaatgtttcctcatcatgaaaatgaaatcgcacaatcttgttgtgcacatggaaaccggtatgttaattactggatacattcaggtatgatcatggtggacaaagagaaaatgtctaaatcgttgggcaacttttttactattcgtgatgtgctaaaccattatgatgcggaaagtgtccgttatttcttgttgacagcccattatcgtagccaattgaattatagtgaagaaaatttggatttggcacatggtgcattggagcggctatacactgctttgcgtggcacagataaaagtgcggttgctttcggaggggaaaatttcattgctcagtttactgaggctatgaacgatgattttaatacgccgaatgctatttctgttttatttgaaatggctcgtgaaattaatcgattaaaaaatgaagataaactgcttgccgatggcttggcggctcgtttgagagaattagccggtattctaggtttattggaacaagatccggaagattttctacagacaggctcggatgatgctgaaattgctaaaatagaggcattgattaaacaacgtaatgatgctcggcaggcaaaagattgggcgagagctgatgctgcaagaaatgaattgacggcaatgggcgttattttagaagacggttcaaacggaaccatgtggagaaaaatgtagtgattgaaaggggcgatattctcgcccattttgatacgttacggttagattttacttatcagcagaataatataatttaccaatctcaattttctgacgaccatttgcttcacgccatttgtttgtatctcgtaaagaatagacgcaaccgcagtattcttgttggtaaaaacgttctcgtttactgatttcaatcattcgttgcgaccctccgcctttacgccaattgtaatcccaataaaccacgtcatcatatttttccgctgcacgatgtccacaaccattaatttggttcatatctttccaacgagaaattcctaagcaactggtaaaaacagggaaaccattttcatgggcatactgtgcggctttttcaaaacgcatatcaaagcacattgtacaacgaattccccgttccggttcatcttccattccttttgcacgatcaaaccaattttgacgatcataatctgcatcaatgaaaggaattccccatttctcggcgaagcgaatattttcttctttacgaattaaatattcttttaacggatgaatattaggattataaaagtaaattgtaaaatcaatgcctgaagcatgaatagcttccatgacttctccggagcaaggtgcacaacaagaatgtaataacagtttattatgcccatgtggtaattctaatttggggcgtacgaaaggtgtattcgaatttttacattctttcttacgacgcttttgtgcatcaaagtgcggttgcttttgttcaagtttggttctgtgcatatctattttcataaggcttgtttgataacgattaaatttaggggaataaatgtttaatttccccagtcaagtctaaaaggttttttattcaaatctgataagtatttttactacaatactcaatgtctaatcattaatagtgcctctcaacggataaataagccaaagaaattaatgcttgcttatattggttttctggtaaacaggaaattgaatcaacagctttttgtgcctcttcttttgctttactcatggcataatccaaagatttttgctctgtcataatggcaagtacatcatccaaaaaatcccgttttccgccctgttcgattgcttcacgaattaatgcagattgttgtggtgtaccattacgcattgcatgtaataaaggaagagtaggtttcccctcagctaagtcatcaccgatatttttacccaaagtcgccgcatttgcactgtaatctaacacatcatcaactagttgaaatgctgttcctaagtatcgtccatagtgttgtaaagcaatttcttgttctgcattactttgagctgttatggcggcacattgtgtagcgacctcaaacaagcgagcggttttactataaatcactttcatataattatcttcacttgtctccggatcattgacattcattaattgttgtacttcaccttctgcaatgatatttgttgcatcggacataatttgtaaaatacgtaatgaattgagtttagtcatcaattggaatgcacgtgtataaataaaatcacctaccaatacacttgccgcattgccgaattccgcattagctgtcggatttccgcgacgcatatcggactcatcaacgacatcatcatgtaacaatgtcgccgtatgaataaattcaacaaatgcagcacaagtaataggctcatcaccttgataatttagtgctctggctgccaacaaagcaatcatagggcggatacgttttccaccactttgaacaatgtaataaccaagttgattaatcaaagcaacatccgaattaagttgtgctagaattgtggcattcactttatccatatctgttttaataagagattggattgcattgatattcattgggttcatttttcctatcatgctgaaactatcataaattaagctaaaagtgcggttgattgtacctgattttctgagctttctgaaattaaactctataaaataagatttttttattttcttaaaaagaaaggcttgcgaagaagccgtttttttcgtagaattcgcaacctatttatatgaattttgatgtgctaaatgaaaataacattataagcactattatctagcggagtatttatgtacgcagtttttcaaagtggcggtaaacagcaccgtgtaagcgaaggtcatgttgttcgtttagaaaaacttgaattggcaacgggctctactgttgagttcgattcagtattgatgatcgttaacggcgaagatattaagatcggtacaccagtagtgacaggtgctaaggtagtggctgaagttgtgtcgcagggacgtggcgaaaaagttaaaatcgttaaattccgtcgtcgtaaacacagtcgtaaacaacaaggtcatcgtcagtggttcacagaagtgaaaatcactgggattcaagcataatttcacaggagttatagaatatggcaactaaaaaagctggtggttcaactcgtaacggtcgtgattctgaagctaaacgtcttggtgtgaaacgtttcggtggcgaatcagtattagcaggtagtattattgttcgtcagcgtggtactaaattccatgcgggttcaaatgtaggtatgggtaaagatcatactttgttcgctactgctgatggtaaagtaaaatttgaagttaaaggcgagaaaagtcgtaaatatgtttctgttgtagccgaataattttattgatacagagtgatgccccacaatgtttttgtggggttttttgtttttagaaaattaatactttattagcacagttaccagtgcggtgctattattgcacgagttttgtatttatataggagggcgaatatgaaacagaaaccattactcgggtttatatttgcattgactactgcgatagcttggggatctttacctattgcattacaacaagttatgaatgctatgagtatgcaaactatcgtttggttcagatttatggttgctactgttgcattagctattttacttaaattagcgaacagattacctaagttatcagatctcaatcgttacttttttggactggttatattaggtgttatagggctatccggaaactttagtctgtttaattcctcattaaaatttattgagccttctgttactcaaatttttgtgcatttttcttcctttgcaatgatgttctgtggagttgtgatttttaaagaaaagttaggattacatcaaaaaattggtttagttattctaattattggacttatcttatttttcaatgagcgagcggaccaattatttgatattaacatctattctataggcgtatttttaagtatgtcggcatccttgatttgggtaacttacggactcgcacaaaaattacttttacgccgttttaactctcaacagattttattgatgatttatacagggtgtgcatttgtttttactccttttgtggagattgagcaattgcaaaatctaaatacttttacgctaatttgttttatttattgttgtctgaatacactaataggttatggtgcctatgctgaggcattaaaccattgggatgttgccaaagtaagtgttgtcattaccttggtacctttgttcactattttatttgctcacttattaaatttaatatacccacagtatttttcagcccctgaattaaatacgctcagctatattggtgcgttcattgttgtctttggtgcaatgacctcagctattggttataaatttatcaagaataaaatttaggagaaaaaaatgaaatttattgatgaggcactgattcgtatcgaagctggtgatggcggtaacggctgtgtaagttttcggcgagagaaatttattccgaaaggtggtcctgatggtggtgatggcggtgatggcggcgatgtatatctaattgccgacgagaatttaaatacattgattgattaccgatttgaaaaacgctttgcagcagagcgtggagagaatgggcgtagttctgattgtacaggacgtagaggcaaagacattacattaagggtaccggtcggaacaagagcaattgataacgataccaaagaagtgttgggtgatttaactaaacatggtaccaaaatgttagttgcaaaaggtggttatcatggactggggaatgcacgtttcaaatcttcagtgaacagagcaccaagacagaaaaccaatggaacaccgggtgaaaagcgagatttgcaattggaattaatgcttttagccgatgttggtatgttgggattacccaatgcaggaaaatcaacatttattcgagctgtttccgcagctaaaccgaaagttgcagattatccttttactacattagttcctagtttaggcgttactcgtgttgatactagccgtagctttgtgattgcagatattcccggattaattgagggggcttctgaaggtgctgggttgggagtacgatttttaaaacatttggagcgttgtcatgtcttaattcatttggttgatattgcaccaattgatgagagtgatccggcggataatattgcaatcattgaaggtgaattatttcaatatagtgaaaaattagcgaataaacctcgttggttagttttcaataaaattgatacactttcagatgaagaatcaaccgcacgtgcaaagaatattatgcaacgtttgggtggggaagatgattattacttgatttcagccgcaacaggtaaaaatgtagacgttttatgccgcgatattatggattttattgaagaaaatccacgtcaagaacaagaaaagatagatgctcaagaagtgaaatttaaatgggatgactatcatcaagaacaattgtccgaacaggtctttacagaagatgaccaagaagaggatgattgggacgattggtcggaagacgatgaggaaggtgtagaaattatttataaaccttagctacagaataaaatatgagggtttccttttttatttaaattgaatgttgatattcatattctaagtaggaaactctcagtttttgtagtaagttgtctgagcaaggctgatcttctacagatatatcaccataagatatctacttgtttttcgtgatgagcggttatttttcctacatttttttcgtaaaaaagtaaatagagaaaaattgtttttttaatcagtgtttctacatcagtaactaagatgtctcttccgctaagttattgaaatatctttgccaatcaaaatattgaccagggtctatttttctattcggagatatgtggcaatgtccgacaatacgttgtttggttattaaaggatatgaatgcataatgtctaaagtcagacgttctaaagattgatattgttcttctgtaaacggttgaagattacttccttccaattcaatgccaatagaaaaatcattgcatttttctctcccttcaaatgaggataatccggcgtgccaagccctatcattgaaattgacatattgtgtaatagcaccatcacgagtaatcaaacagtgtgctgacactcgaatgtttgcaatagtggcaaaataagggtgtgcgagaggatcaaggttacctagaaaaaaatcatcaatatacgaaccaccgaattgctctggcggtaagctgatgtaatgaataactaaaagggaaatatcactattttccggacgttgatcaaaatgtggagagggtaattttctagcctctgaaaaccaacctgtgcagatatttttttgtttattgttcataaattattatttttgcgagtcggctcgcagaaaaagtgcggtctatttgtcggtttttttcaatttctacaaactttcacttgccattcggcattgtcattttatttaaaaaaggaaacattatgaaaataacctatattttttcatcagctaaaaaaggatttactctcatagaactgatgatcgttattgctattgtggcaattcttgcaaccattgcaattccgtcataccaaaattatacaaaaaaagctgcaattacagagctgttacaagcttctgctccttatcgtgcagaagttgagctatgcgtgtataacaatgatgcaccgacaaattgtaatgctggaacaaatggaattcaagcggcaatcaatacaccaaaaggtaaagtaaaatcagttagcgtgcaaggtggagccattactgttacagggaatggaaatcttaaagatattacttataccttaacaccaacaggcgatgcttcaaccggcgttacttggagtgcaaattgcaataataaggctgatctatttcctgccggattttgctcttctacgtctacaaactctccttaaaccattaattacggtgggttgtctcaccgtttcatattaattgcactataaaaagaatttttttgcaaaaatattgcatatttattcaaacggtgataatgtttgcgtaaatcaattaataaccaaaacgagatcttttattcaaatgacaattagtgttaaaaatttaaattttttttatggtgcatcacaggcactgtttgatattaatctcacagctgaagatggtgataccgttgttttattgggaccaagtggtgcagggaaaagcaccttgattagaacgttaaacctacttgaagttccaacatctggagaattgagtattgccaataataaattcgatctctcgcaagatattgccaacccaaagcaaatgcgtcaattgcgtcaagatgtaggtatggtatttcaacaatacaatttatggcctcatttgactgtaatggaaaatcttattgaggcaccgattaaagttttagggatagcgaaagaaaaagccaaagaacaagctattgaattattaaaacgattacgcttggaagaattcgctgaaagatttccactgcacttatcaggaggacagcaacagcgtgttgctattgctcgtgcattaatgatgaagccgcaagttttattatttgatgaaccgacagcggcattagatcctgaaattacagctcagattgtatcaatcattcaagagttacaggaaatgggcattacacaagttatcgtaacgcatgaagttgcggtggcaaaaaaggttgcaaccaaagttgtctatatggaacaaggtcgcatcgttgaaatgggggattccagctgttttgaacaaccctcaacagagcaatttaaacaatatttatctcactcacactaatatttaaggagcttattatgaaaaaattacttttagcaacaatgttggcagctgctacgattggtgcaaatgcacaagatattacttttgctatggaaccaagttatccaccatttgaattaactaatgaaaaaggtgaaattattggttttgacgttgatattgctaatgcaatttgtaaagaaattcaagctaattgtagcttcaaagcccaagcgtttgatgcgttaattccaagtttaattaaaggtcgcggtgggtttgatgcggcaatttcagcgattgatattacggaagcccgtgcaaaacaagtagcatttaccgattcttattatgaaagttctgccagttttattgcattaaaagggaaagcggatttaacgacggcaaaagtggttggtgtacaaaacggtacaacgtatcagcaatatgcgaataaagaagcgaagcaatatcaatctaaatcttatgccagcttacaagatgcaattttggatttaaaaaatggtcgtattgatctcatttttggtgatacggatgtattaagagatatgtttgataaaaatccggaattgcagtttgtgggcgagcgtgtaacggataaacgttatttcaataacggcttgggaattgcggtaaataaaaagaataccgcacttgttgagcaattaaataaaggtatttcggcaatcaaagcaaacggcgaatatcaaaaaatttatgataaatggatgactaaataattttatgtttattgattatttacctttaatgtataccgcaaccctgatgaccttagggttggcggtttgttctttattactcggattggcattatctattttctttgtagtattagaaacacacaaatgggcatgtattcgtaaaccgacagccactattgtgacattattacgagggttacctgaaattcttgtggttttcctaatttattttggcgtacctgaaatactggaatgggtaatcggagaatatgtagagtttggtgcctttggttgtggcgtggttgcactgtctattatttttgcttcttatgcttctcaatctttgcgtggagcaattcaggctatacctttaggacagtgggaatccggtgcggcattaggtttgagtcgtagttatacgtttatttttcttattatgccgcaagtttggcgacacgctttaccgggattgagtaatcaatggttagtgttattaaaagataccgcacttgtgtcgttaatcggtgtgcatgacctaatgcgtcaagctgaattaatcaataccaatactcaccaaccttttacttggtatggatttgcagcattgctttatttgttgattacgctatttagtcaatttattattcgtaaacttgagcggcgagtcacacgctttgaacgtgctacaaattaaaggatgaaaaatgattaaagattattttttaacaattgcacaaggaattccaacaagcttaattcttactatagttgccttgctggtagcattttttcttgctttgacattaacttttgctctttctatggaaaaaaaatggttaagtcttccaattaatctttttctcacaatttttactggtacaccattactggtgcaatttttcttaatctatgcaggaccgggacaattttcttggattgtaaatagttttttatggcctttattatcaagtgcgtggttttgtgcaatacttacattagctttaaatagtacagcgtattcaactcagcttttttatggtgcggtaaaagcgatttctaaaggacaatgggaaagctgtgttgcactaggtttgagccgttggcaaactttgaaaattcttgttccttacgcattaaaaagagcattaccttcatatagcaatgaaataattcttgtctttaaaggcacatcgcttgcttcaattatcactattttggatattatggggtatgcaagacaactttatggtactgaatatgatgcactgacaatttatggtatcgcaggcgtaatctatctcattattacaggtattgctactttattattacgcagattggagcgtaaggtgcttgtatttgagcgtttagaaacggagcgagtgtaaatacataataacaaataccgaaaagtgatctgtgccttaatttatcgtttatgagttatctatttaagatttaaggaacagatcaatatcggtaatcaccaattgctatttcgtatgaagttttgccaatccgatatcacaacttttgatttgtatatcatgctccatggcgagaatttgttgcttactttgttttaatttactttttatttttgccagttgaacatgtgttcccggctgtttttctgcctcagcaattagattttctgtttctttaaataatttttggcactgctcaggcagagtgtttgcttggacatgagttgttgttatagttgcaaatacgctagctaaaataatcattactgatcttggttttagcattatattcattgataacctcttgaaattttttcagaaaaccttcggaaactatcaaaaaaagactgacatgtctagttatttattgcttcatatttttttgtaaatttttactatttggaataaatgttaaaaattgtgaatattctataatgtttgatgtatatcaatatataagaaagtgttaaagaaatgttatttgatttagatctaaaaatgtgatctttataacacttttattgttttttattcttacttttagtagtaaaattaataccgtttttgggttatccacatgacatttaatggtgaactgtgaaacttatgtaaattttatgttgtatgttcatttaaataaatgtttatgaggatagttcagtaaatctacttgaggtttcaacttgagtatttgaggggtggttacatagtaatcattgtgaaaaacttgtagcattgcacaaggagttggagatgttggacgttgttgaactctctagattgcagttcgcgttaactgcgttgtatcactttttgtttgtaccgctaacattgggtttgtcatttatccttgtgattatggaaactttatatgttgcaacaggcaaagaagtgtataaagatatgaccaaattctggggtaaattgtttggtattaattttgccttaggcgtgacaactgggattacaatggaattccaatttggtactaactggtcatactattctcattatgttggtgatatttttggggcaccgctcgctattgaagcattacttgcatttttcttagaatcaacatttgttggtttatttttctttggatgggatcgtttatcaaaagctaaacatttattaactacatattgtgtagcatttggttctaacttttcggctatgtggattttagttgccaatggctggatgcaaaatccggtagcgtctgagttcaattttgaaacaatgcgtatggaaatgaccagttttatggatctttggttgaaccctgttgcacaaagtaaattcttgcatacattgtctgcgggttatgtaactagtgcatgttttgttttagctattagttcatattacctcctaaaaagacgtgatgtcggattcgcaaaacgctctttctctattgcatcagttttcggtatcattgcaactgtttcagtattgatcatgggtgatgaatctggttacgaaattggtcaaacccaacctgtaaaattagctgctatggaaggtgaatggcatactcaaccggctcctgcgtcttggaatatgattgttgtacctaatcaggcagagcaaaaaaatgattttgctttacaaattccttatgctgcggggattattgttactcgctcattagacaaacaatttacaggactagttgatctacaagctcttaatgagcaacgagttcgtaacggtatggttgcctatggtttactacaacaattgaaggctgagaaaaaggccaacggtcaggttaatgaagaaactaaagcacaatttaacgcagttaaagatgacttaggatttggtctattactcaagcgttatactgatgcggttgtagatgcaactgatgagcaagttaagcaagcagctgctgatactatcccaaatgtaggaccaacgttttggtcattccgtataatgatgcttgccggtggtttaattctagttctgatgattgctgcattcgtacaaaatatgcgtaaaacagtagggcgtagtccacttttattaaaagctttattatgggggcttccacttccatggattgctatggaaagtggttggttcttagctgaatatggacgtcaaccttgggctatttatgatgtactaccggttggtgtggctgcgtcaaatttaacaacagctgatctttggttatctattggactgatttgtgccctctatacaatcttcctagtagtagaaatgtatttgatgtttaaatatggtcgcttgggtccgagttcgttaaaaaccggtcgttattattttgaacaattatctaaataagcaggagtctaaccatgattgattatgaatttctacgttttatttggtggattttagtcggggtactgcttattggatttgcagtaacagacggatttgatatgggagttcttagcttattacctttcgcaggcaaaaaagaagttgagaaacgtataatgatcaattctatcgcaccacattgggatggaaaccaagtttggttattgactgcaggcggtgcaatgtttgctgcttggccgatagtttatgcagcctctttctccggcttttatattgcaatgattttagttttagccgcactatttttccgtcctgtcgggctagagtatcgtgctaaaatcgataatccaacttggcgtaaattttgggattggggattatttgctggtggttttgtcccatcattggtattcggtgttgcattcggtaatttattgcaaggtgttccatttgaatttaatgatttgatgcaagtaacttatacaggttctttctttgaattattaaatccttttgcgattctttgtggtttaatcagtttttctatgttaaccacacaaggtgctgcttggttacaaatgaaaacaacatcagaactgcgtgagcgtgctcgtgtaataacacaagtaggtgcttttgttacattgttgacgtttattttggctggtgtttggttatatttcaaagaaggttttattgtaacaagtgtccttgatcataatgcaccatctgacccaactgttaaaacagttgcagttgaagtgggagcttggtttaagaattattttgatgcacctgtgttgtttattcttccagcattagcagtgggtggtgcgttgttaaatattttggcatcaaaagccaaccgttcaggatttgcatttttcttctcgtctatcacgatggcaggaattatattaacctgcggtgttgccatgttcccatttgttatgccttctatttctcatccgaatatgagtttattaatgtgggattcaacatcaagtgaattaacattaacactaatgcttggttttgcactgttctttgttgttattttactgagctacaccatttgggcttatgcgaagatgtttggtcgcttagatgctgacttcattgaagaaaacaaaaactcattatactagtaaggagataagattatgttttatgtgttatgggtagtgggtgttttgttcgctgttatgctaagtgcaatcattactatcggtcttgagaagactggtaaactcgacgaataaagagttttctttatcaactgaaaaataagggcttttaaagagccctttcatttcttctgttgtgtaaatttttcatgatcaaaagtaaaagtatttttaactaagcactgggtttattttaaggtgcgatgtatagtctaaaaaaatatttttcttttcactgtatttattcttgctaatatatttgactgaatctagaatacttggttcatttttcatatagaaatgagaaaataaaagactttgtgagggagagtaatatgcctgtttttaaattgcctgttcgtgtgtattacgaagatactgatgctggaggtgttgtttatcatgcccgttatctccatttttttgaacgggcgagaacagaatacttgcgaacattgaatttttctcagcaaaacttattaaatgagcgaaaagttgcttttgttgtgaagtcaatacagattgactactgtgttcctgcaaaattagatgacctattaattgtggaaacttatgttgtagctattaagggagcaagtatagttttttcacaaatattgaaacgagatgatgagatcatttcacaagctgtggtgaaagttgcgtcagtggatcttgtgaaaatgagacctgtggctatacctcaagaaataaaagcagaaattaaactaaatgataacattttcggagttatgtcatgaccgctgaattagattttttagaattatttttaaaggctagtattgttgtacaaatcgtaattgtgatattaatatctttttcgattatatcgtgggcgattattatccaacgtagtcgcattttaactcgagcattaaaggacagcacactttttgaagaacgtttttggtctggagaagatttgtataaattatatgatggactttctaatcatcgtaatggtctaaacagcagtgagcgaattttttatgttggatttaaggagtttaatcgtctgaaacaagctaatccggatgcccctgaagccattattcaaggcagttctagagcaatgaatttagcaatgaatcgtgaagtggaagatttggaaacacgagttccgtttttggcaactgttgcgtctattagtccatatatcggcttatttggtacagtatggggaattatgcatgcttttatggcattaagtggtgccaaacaagcaacattacagatggttgccccggggattgctgaggctttaattgcaacggctattggtttatttgctgctattccagctgtaatggcttacaatcgtttaagtctacgtgtgaataaattagagcaaaattatgctaacttcattgatgaatttacgacaattttacatcgtcaagcatttggtaaaaatcattaaatgtatcaaaattctccgtactgacggataaagtgcggttcttttttcataagtttagaggctatctatgtcttatcgtcgaaaacgtcgagatattaagtcagaaattaatattattccttttttggatgtcttattggttttattgctcatttttatggcaacagcaccgattattagtcagagtgttcaagttgaacttcccgaggctgtagaaagccaaaatgtatctaaagaagataaaacgcctgttattttggaggtttcaggtattggacagtatgcactttccattggtggggagcgaactgagggcataacagaagaattagtaactcaactttctaagcaagaatttgacaaagataataatacgttatttttggttggaggggctaaagatgttccgtatgaggaggtaatcaaagctttgaatttacttcatgttgcgggaataaaatctgttggattgatgactaatcctctttaaatataagtaggtaacacagtgtgtaatcatcgacaaaaaaatgagcttggtgccattctgctatcaatttttctgcatattttgttattaagtttgctggtattaggctctaactataataatgttgaaatcatgggaggtggagaaggtgatggtgaagtaatgtctgctgttatggttgatacgggaaccattgcaaaagagtggggacgtttacaggaaaagaaaaaaagcaatccggataaacaagaaacctttgttgaagcaacgcaagaagacgagttaatggagaatgttgatgtatttgaagaaaaaataagagaagatgaagaggtacagaaaagacttgcagagcaaaaaataaaagaagaaaaaattcagcaagagcgtttagcaaagcaattggaagaagataatgccaagaaagaggctgttgcaaagttgaaagcagaggctgaagaaatgcgtttacaggcattggcaaaaaaaattgaagaagagaaaaaggttagagacgctgaggaaaaacaaaaagcagagaagttagcgaaagagagagcagagaagttagcaaaagagaaagcggatagattggtcaaacaaaaggcacttaaggaagcaaaaataaaagcggaaaaagcagctaaagcaaaagcggaattagctcaacgcaaagcggaacaagcagcgttagatgattttttcaatggaggtgatattgcaggaagtagcaaaaatggtggaaatgcagcgatgaaaggttctcaaggagtgggtgctggttttgaaaacggcaaaggcggaagaactggagagcaatatgctgctcaaattaagagagaaattcagcgtcgctttctaaaagaacctaggtttgctaataaagtttgtgttattgaggttgaattagcaagagatggaacgatcactaactttagaaaattatctggctcagacgatatttgtactgcggggttatcagcggtatctagaacgaaaaaggtaccggaggcaccaactgatgagatttatagaaaatataagaaatttccactcgaatttagattgaaataattaaagaaactaaaaggtaaaatttatatgaaattttctgcatatttaactacattattcatagtgctttttagtttgttcatacaaaccgtacaagctgaaagtgaggtaagaattgtcattgatgaaggggttgatagtgctcggcctattgcgataattccatttaaatggaatggtagtgactctatgccgatagatgtagctgatatcatttctgcagatttacgcaatagtggtaaatttaatcctattgcagtcagtaaaatgcctcaaaaaccgacatcagcaagtgaggtaatttccgatgtttggtcttctttaggcattgatgcagtagttgttggacaagttacacccaatgaaaaaggatacagtatcgcatatcaattagtagacactatcggtgcttcaggaaatgcgggagaggtactaagtcaaaaccagtacgctgtaccgaaaaatgctattcgtttaggtgctcataccatcagtgatgaagtttttgaaaagctgactgcaattcgtggtgcatttagaactaaaattgcatacgttgtacaaaagaacggtggctcaaaaccttatcaagttcgtgttgcagattatgatggacataatcaatttattgtttatagtagttcgcaaccattgatgtctcccgcttggtcgcctgatggtagtaaattggcttatgtatcttttgaaaatcgtaaatctcaattaattgtacatgatttacagtctggagctcgtcgggttattgctgcattccctgggcataatggagctccggcattttctcctgatggttcaaaattggcatttgcttcatcaaaagatggcgtattaaatatttatgtcatgaatttaggaagcgggactatctctcagttaactagcggtgcaggcaacaacacggaaccttcttggtcaccggatgggcaatctataatttttacttcggacagagacggcggacctcaaatttatcagatggatgtagttggtaatggtatatcattagtttctgctggtcgggggtatagtggaaaaatctctgcagatggtagtatattagtgatgatttatggcgataatattgttaaaaaagatttggcgacaggtgtgacggaaatgttaagctctactttcttagatgaaagcccaagtatttcacccaatggaattatgattatttatagttctacacaaggtctaggaaaggtgctacaattggtttccgctgacggtcgttttaaagcacgtctaccaagtagtgacggtcagattaaatttccagcttggtcaccatatttaaataaaaactaggagaggttaatgaaaaactttgcaaaattattagtagtagcgggttcagtggcagtattggcagcttgtagctcatctgataacgcatctaaaacaaatgctcaaatgtttggcggttattctgtaactgacttacaacaacgttataatacagtgtattttgaatttgatagttatgatgtgcagggcgaatacgctcaaatcttagatgcacactcagcatacttaaagtcaacaccagcttctaaagttcttgttgaaggtcatgctgatgaacgtggtactccggagtataacatggcattaggtttacgtcgtgctgatgcagtaaaaaactttttattaaataagggtgttcaagctagtcaactttcaaccctttcttatggtgaagagaaaccggcagagttaggtcataatgaagctgcatattctaagaaccgtcgtgctgtattagcatactaatttcttaagccgggtatgatgcccggttttttattgcattttttcagtaaattttgaatttaagtaggtatatttgttttaaatgcctcttttctgccgactattcgttcaaataaacaaaaaataaaaaaattttattgattattaaaataaaaacagtaatatatccgctcgttacaaacaatgagggtcgttagctcagtcggtagagcagcggacttttaatccgttggtcgaaggttcgaatccttcacgacccaccattttatttgtaatatcccaatttatgggtcgttagctcagtcggtagagcagcggacttttaatccgttggtcgaaggttcgaatccttcacgacccaccattttatttgtaatatcccaatttatgggtcgttagctcagtcggtagagcagcggacttttaatccgttggtcgaaggttcgaatccttcacgacccaccagtcatgtttaaagattcattcataaaaatattggttattcttatttatcgtgtcttttctgtttgtttctcttaagaggacatatacttaaaattagtcacttttctttttactaaattctatttttgcgatctgtatcgtaattttttttaattatttttacccatttttctagatgagttaaagtgcggtcaaaaataggaaaaaaaatgaaagcattaaaggggtttactctattagaaatattgattgttttactgattatcagtatgacagtaacattttcttttcccatgtggcaaacagcaaatacaaaaatgattttagaaaaagagcaaaataaactctatattttcataagggagctacaagctcgagttgaaaattctaatgatatttggtttttaattgctaatcgtgatttagtgagtaagcgttggtgtctggttgcacaaccaaaaaacacagatatatgtgattgtttaaatcctcgcagctgtaatagaaatattccgatgaaattttattatccttattttgcagataaaaccatgttaatcagcaaagtttattatcctagagaaatgactagattaaatggtacaaggaatacaagtacgacgacttgttttgtgttgcaatctgatcagcaaagaacagtattttcgttttttaatgtaggatctttaaaacttaaaggttaccaatcgttaagtgcttgcgtgaatgatcattagtaagggggaacattgattatttatcgtggacaaactttattaagtgtaatgatagcgttgagcttatcaatgatgttattaatgagtgttagtgcattttatagttatagtcagcaacaaaataaacagatacttttgcatctctatttacaatcagaattgcaacgaactatccaacttttgggtaaggatattcgccgtagtggatttagggctattagtgataaattggttcggagtaatttcgatttatttgaacaagataaaagcggaaagagtattgtagtcgctcaagctgataatgaacccccgaatagttgcgttctttttatttatgatcttgatgctaccggctgtgtaggtacgacatatcgtaataatgtttgtgtaaggaataaacaaaatacagctcgtgaaattgagcgagagttatttggttatcgcttaaataaacaaatgatagagacaagattaacttataaaaattcaattagtgcgaattgtaatcaaaaacaatgccaaagctatttacaacaacctgcatgtaatagcggagggtgggtcgatttattagatgaaaatgacatagccataactgcattaaaatttaattggattgctgattacaatggattggaagtttatctaaaagggcatctaaagcgaaataaacaagtcgaatatgagacttcagctattattcctttgcttaatcaaaagagataaaaatgaatatacaaaaaggagttgtaacgctcaccctattaatgctgttaagctcagtattattaattttacttttttttgatggtgatttgatttcgttgcattcatccattgtttctcaacggaaaatatatttagaacaaagtcttatattacagagacaaagtatttctcaaaaagaaaaactttgtgaaaaccagcctctgaataataatttgaaaagtttgaagatcgaatttgaaagtcgacgaaaaattgaccgcacttctcaatttgtatggtgtgaaagaaaatatttgtttaaaaaaaggccgaaaaaagctacttatgaggcaaggctaagtcagtatataaatcttgagttactggacttatttcaacataaattacattcaccgcctgctattttgccgagagataaagtaaattacctctattgggttgaggaaaaatcagctgaattggagatacaaggtaatattaatgcagttgttattgctgaaggggatttgaagttaacaggaaaaggtaaaattagtggaacggttattaccggcgggaaattaagtattgaaccagcagttaaaattgtgtatcgctcaaaaacaatcatcgatcttatccgatcatatagttattggcagtttgcggagaatagttggtatgattttcaaccattataaatttcctcaacggggtaccagcttgatcacgttattagtcacaatgatgatattttctacattatttttatttgttaatcaatgggttagttatcaaagaaaaagtgcggtaaatatttatctacgttatcaagctttgcaaatcgctgaaaatcaacatcaacgcttatttctagaaccgcattttcattgtccgcataatatcgagcaaaacggttataagtttaagatcaattgtgaaggtaagaatgtacgagtttcttatgcaaatcaacaagtaaatttattgcttgattaattattttgaaaagctatgctaaatgaagttattagaagaataaggaacatttgtgtttactttgtattattccaatcaattggaaacgcaaaaagatattttgttacatttaatggatcaacagccattatcagatcctttccaaaaagaagttattttagtacaaagtggcggtatggcacagtggatacagtggcagattgcagagaaaaaaggtatatcggcaaatttgtcttttcctatgcctgcaagttttatttggcaattatatgttgataatttatcgcaagtcacagcttcttctcaatttagtaaagaaaatatgacttggcgattaatggaaattattccgcattatatagatcaaccggaattttacatattgcgtcaatatttacagcaaagttaccaatcaagtcagcagcgatactaccaattagccagcaaaatagcagagttatttgaccaatatttagtttatcgaccggaatggattataagttgggagcagaataaaggcgtagaaattattcagcaaattcagtattaccaaaaaaatttatctgtctcagaatcatgtttttctcaagttgagcaacatattgtttggcaaggtattttatggagagctttagtatgctctgtgcaaaaagaaacacaaaagaatgttttacatcgtgcacatctacatttacttttcttaaaacatattgccggcgaaaaacctaaaaatttgcctacgagaatttttgtatttggtatttcagctttaccgaaggtgcatttagatactttaagtgcattaagccagcattgcgatgtgcatttattttttaataatgcttgtcgtgaatattggggagatataattgatcagagccattggcaacgtttgaaagtgcgagagcgtataagttggcaagatttccaacaaccacaaaatacacaggcttggttatccgatgagcaaatacatacttttgaacaaaatggatttgaacaaatttatgatgaaaagttacaggttggcaatcctttgctttcctcatggggaaaattaggacgggattatttgtatttactcactgaactggaggctaatgaaatcaatgcttatgtcgaactttcggaaaaaacgttgttgtcgcaagtacaggcactcattttagatttggttccttcgaagcacaagtttttaaatttggcagaaaatgaccgctctttaacttttcattcttgttatagtccaatacgagaggttcaagctctacaagattatttgttacatctatttaaccaagctcaggatttgacacctaaagatgtggtagttatggttgcagacattgataaatatgcaccatatattcaggcggtattcagtcaaggcgaacactatattccgtactctatcgcagacagcaaactttccgaaaatgaccctttagtatctgcttttttacaattgttaaatttaaaagaaagtttattcagtgcggaggaagtgctgacttttttggatcatcctgttattcgtcagagttttaatattactttagaggatttggcacaaattcgtcattgggttgagcattcgggtattcgattcggattagaaaaatatccgcaacaatccttgcaaaattataacgcttggcaggcaggtttagagagaatgttactgggatttgctatgcgggaagaaaatggtctatggttagatacgcttggctttgatgatacctatggattaaaagggcagcttgtcggttatttaaaggattttattactcgtttgtatcaatggcatcaatttttgcaagtagatcacgttattgaaaagtgggaagaacatttaattgaattaatgtcatctttttttgtggtagacggaatggatattccgcaacaatacaaaacaacttttaattatcttattgacactattcaacaattaacggagttgatcctagatagctcttttcagcaagaaataagtgcggaggttatttacgaagtttttgttgaacgcttaaaagatatacctaatagcctaaaatttttaatggggaaagtcactttttgtacgcttctccccatgcgatcaatcccttttaaagtggtgtgtttacttggtatgaatgatggtgattatccacgtcaacaaacgccgaacagctttgatttaatgcaatatcatcgcaaaaaaggcgatcgttttcgccgagatgatgatcgctatttatttttagaagcattgatctcggcacaacagtatttttatgtgagttatattggtcgctctattattgatgatagtgaacgagaaccttcagttcttgttacgcaattgttggattatatagctgaaaatattaacgctcaaggtgatctaagaggacaagatattctgaaaaaatcacttattcaacaacatgcgatgactgcatttagccgagaaaatttcaccaaaagagaccgctctttttctaagcaatggctagtgttggcaaataaaaaagatagtggcaatttggcgaattttttacagccgataaatgatacagagatagttaaagaaatttcattaaatgacttaattgcgtttattcaggatcctgttcggtatttttttgagcaaaaattacgtgtttttttacgtaagacagaacaaaatattgcggatactgaaaattttactttagataatttagagttatatcaaataaaagaagaacttatttatctttctgagcaggaatgggaagacttttttgctcggatgaaaattaagggaattatgccacaaggggcgtttgcaaaaatttatcagcaaaaaacaaaaaatgagatcattacacttaaatctttagttacgccttatttggataaaatatcggaacaaatccctcttgatttacacattgaaacagaatacggaaaggtacgtttaatcggtagcattgactgcttatatcatcaaaaaatgcatcgagtaacttggcgagcatctactatcaaaacgaaagatattatccaaacatggatttatcatttagtacaaactttagcgggagagcctaattcgcaaattgagcattactctttagacagcagactttcttttgaaaaaatagaaaaatctaccgcacttcaacagcttcaaacttatgttgaggcatatttacttggacaagtttcagtgttattaatgccaatgaaaaatttcgatcaatatcttcaattgctttttactccgaagagtaataaatggaaagaggaaaaagatattgatttatctgcttgttttgaattgttatcagaacttggctcaggtagaaaagagagaaatttttatgtgaaaacagatccttattggcaaagaatattagcacaaacaaaactagacgattcacatattttagaaattaatcaacgtgttatacaatggttcgatttaatgttaatgctaaaaagagttgaatagaaaataaaaacaaaactggatatttatccagttttgttttatccttagtgctttattttacgctatgtaaggtgagatatgattgggcgtgtaacaggaatactggttgaaaaacaagctccggaaattttactggatgttcaaggtgttgggtatgagttacttttacccatgacaagtttttataatttgccggaagttgggcaggaaactacgttgtttacgcattttgtagtgcgtgaagatgctcatttgttatttggatttagccataaacaagaccgctctttatttcgtgaattgattaaaaccaatggagttggaccaaaattagctttagctatcctgtctgcgatgtcagtgaatgaatttgtgtatgcgattgaacaagaagaattatctaaattagtcaaaattcccggagtaggaaaaaaaactgctgaacgtttattggtggagctaaaaggtaaatttaaaggcttacaacaaacagatttctttattaaaagctctcatttacctggaattaaatgctcaaaaccggatcaaagtttgcagttggatgaagcagtttctgctttaattgcgttaggatataagcctattgaagcagagaaaatggttaaaaaagtgttaaaagcagatttaactagtgaacagcttattcgagaggctttgaaagccgcattataagagatagagaatgattgaagtagatcgcattgtaagtgccaatgcaaaagtagacgatgaatatattgatcgtgcaattcgccctaaattattgagtgattatatcggtcaacctcaagttagagagcaaatggaaattttcatccaagcagcaaaattacgccaagatgcacttgatcatttgttaatttttggaccccctggactaggaaaaacaacgttggcgaatattgttgccaatgaaatgggagtgaatattcgtactacttcaggtccggttttagaaaaagcgggggatttagcggcaatgctaacgaaccttgaacctcatgatgtattattcattgatgaaattcatcgcttatcaccagctattgaggaagttctttatccggcgatggaagattatcaactggatattatgattggagaaggtcctgctgcccgttcaataaagctggatttaccgccttttacgctgattggagcaacaacaagagcaggctctttgacttctccattacgagatcgattcggtattgtgcagcgactggagttttattctgtagaggatttagcttccattgttactcgaagtgcggtctgtttgcagcttgaaattgatgttgaagcaggacaagaaattgcttgtcgttcacgaggtaccccacgtattgcaaatcgcctattacgccgagtgcgagattatgccgatgtcaaaaatggtgggaaaattaccgcacttattgctcaagaagcactgaagatgctggatgtggatcttgcaggatttgattttatggatcgtaaattattacaggcaattattgagcggtttgatggcggacctgtaggattggataatttggcggcggcaattggcgaagagcgagatactattgaagatgtactggagccttatttaattcagcaaggatttttacaacggacacctcgtggaagaatagcaacatcaagaacttatcgacattttggtttggaacagattgaaaaatagcactcctttttcagtcactctcaacgtgagtcagtcgatagtcaaggatttcaagcaacttataggcttgtgcgagtatccttctattctgtagtaaagattctgcaaaggtactatttattgctcaaaatcccatttgcacacacataggctgagctccatgcccattggaagttataaccgccaagccgaccggtaacatcaagtacttcaccaataaaataaagacctttgattttatgactttccatcgtttttgatgagatttcttgcgtatctacgcctccaatagtgacttctgcggtgcgataaccttcggtgccgttaggttgaatttgccaatgatgaattaaatcatcaagattttttaactgcactttgctgaggttggcaatcacttcatcttgaataatgttgtgatttaaccataaatccactagtttttgcggtaataggcgtgataaggcggtttttaaatgtaatttaggtgaggtctgacgtaacttgttaaggaaaaattgaatattttccatcggtaacagatcaatttctatattttcattcacttgccaataatttgaaatttgtaaaatagcgggacccgatatcccccgatgagtgaagagtaaattattgctgaaagattgaccgcactttgcggttacacaaacaggaagggagatgcctgaaagtgcggtgtaaaatttatcaatttcacgccatgtgaagggtacaagcccagctcgtggagcaataacattgagcccgaattgttcggcaacttggtaaccgaaaggtgtcgaactcaaggctggcatagacaatccgccggtagcaataactaaattttcacattgccaaatttttccgtcagattgcaattgaaaacgagctttttcattaccgtctaatttttcaatgtattcgatctgttgacgtaattgggtattaacttgaaatttatcgcattctgctcgtagcatattgacaatatcttcagcactgttatgacaaaaaagttgccccgattctttttcataatagctaataccatagtcagtaatgagggcaataaaatcccattgggtaaagcgagctagagcagacttgacgaaatgaggattttgcgaaaggtaatgctgaggggtaacattaaggttggtaaaattacaaaatccgccaccggacattaaaattttacgtcccactttttttccattatctaaaatcgttacttggtgcttggctttacctagttgaccagcacaaaacaagcctgccgcacctgcaccgataataattgtttgggaataattcatcattatttattcgctaaaattaccgctcttttgggagccgggtacccttcaatggttttactgtgatcttgaggattaaggaaatcaattaaactttcattttccagccagtctgttttacgttgttcttctagacctgttgtttctacatcgacacaacgaatattatggaaaccgcacttttccagccagtttatgagtgcgagaacggaagggataaaatacacatttttcattttggcatagcgatctgtcggcactaaaatcgtgtttatatcaccctctacaactaacgtttcaagtactaattcgccatctttaactaattgatttttaagttgtgtgagatgatccaatggagattttcgatgatataaaacgcccatagaaaagacggtatcaaaggcggctaaaggttgcatttcttcaatgccgagcggaatcagattagcacgacgatcattgtttaacagtttacgtacagcctcaaattgacataaaaacagttctgtcggatcaataccgactaccattttggctccttcgccaaccatacgccacatatgataaccgctaccacaccctacatctaacacaagacgattctgcaaaggtgccaaatgaggcaagacacgctcccatttaaaatccgaacgccattcacaatcaatatggataccatatagatgataaggtcccttacgccaaggcataagctgttttaagtgatgaatgatgcgttgtcgctcaccggaggaaagaggcgtttttgtttcagctttgaccgcacttttgagatcaatatgatcggctgttaagtgcggtagaaaatcaatgatttttgaccatttaatataatcgccatgggtttgcttttcccattgtttaagttgtaaaggcaaagtttcaagccatgctgaaagtgtcgaagttgctatttgttgatagaatggacgaaagtcgaacataattattttgatgccttatatgcgtttttagcttgttcaaacgtctctaaaatcgatttttccggtttcactgataacaaagaaacaacaataatgacaatacttgccaaagcaaaacctgggatcatttcatataatttagagaattcacttgttgtagggacaatggttttccaactaaatacgataattgtcccagttaacattcccgccattgcagcagaagatgtcatgcgtttccagaataaagaaaatagtacaacaggcccaaaagcactgccaaatccagcccaagcaaattcaactaattttaaaacttggcttttttcatcttgtgcaatccaaattgcaatggcggcaatagctaataccattaagcgaccaagccacatcaattctttatccgatgcttttggacgaataaatcctttgtaaaaatcttctgtaacggcactggaagaaatgagaagttgtgcactcagcgtactcattactgcggctaaaatagcagaaagtaagataccggcgatccaaggattgaacaataattttgataattcaataaagatttgctccgattctttgttgacgacaccagctagttgtggatttgctgtaaaataggcgatgccaaaaaaaccgatacctatggcaccggctaaacaaaggatcatccaagtgatactaatacgtcgtgcgttattgagcgattttactgtgtgtgccgccataaagcgtgccagaatgtgcggttgtccgaaataacccaatccccaagaagccaagctcagtagaccaattgtggtagtaccggtaaaaatatctgtaaagttttttcctaccgcactttcagcctgcttcaagtagaaatgaaaattatctattccgtctaagcttagaataatcatgataggggttagaatgagtgcgaaaatcatcaatgttgcttgaatagtatctgtccaactcactgctaagaaacctcctatgaaggtataagcaatagttgccaatgcaccataccaaagtgcggtggaataagggatactgaacagattttggaataattttgcaccggcaacgacaccggaagcacaataaattgtgaagaaaacaaggataattgaggctgacacaattttgagtaaattatgacgactaccaaaacggttgtgaaaatattcaggtaatgtgagagcgttattattaaattcagtgtaaatacgtaagcggcctgccacaaataaccagttaaaataagcaccgattgttaaacctatggcaatccaaccttcaattaagcccgacaaatagattgtacccggtaaacccatcagcaaccaggcggacatatctgatgcaccggcagacattgcggtaacaaaactgcctaaacgacgaccgccaagaatgtagtctgaaagattattggtgtagtaatatgcaagtgcaccaatcaataacatgcctaagatatagacaataaaggtaataattgttggatcaaaactaaacattaagccctcacgaaagcattatttgtatagataaaatttaagaaaggtcgcattttaccttattcagggctattattctatttaccttttcgatagactaattaaaagaagtatttttaggatagagatgatggaatctgttgaattattggctaacattacccctagtgaaacccgaattgcactggtggataatggcattttaaaagaagtacatattgaaagacaggcaaaaagagggagcgtcggtaatatttataaaggacgagtgactcgagtattgccgggtatgcaatctgcatttgtagatatcggattggaaaaagccgcttttttacatgcctcagatattgtttcacatacagagtgtgttgatgttgatgagcaaaaacagtttgtagtgaaagatattgcacaattggtacatgaaggacaggatattgttgttcaggtggtaaaagatcccctcggtactaaaggtgcaagattaacaactgacataacactcccttctcgttatcttgtttttatgccggaaaatagccatgttggcgtttctcaacgcattgaaagcgaagaagagcgggcacgtttaaaggaacttgttttaccgttgtgcgatgaattgggcggttttattattcgtactgctgccgaaggagcaacggaaactgaactcgtgcaagatgcggaatttttaaaacgattatggcgtaaggtgttggaacgccgtgcgaaatatacaacacgttcaatgttatatggcgaattggcgttaacgcaacgtattttgcgagattttatcggggcgaatttcagtaaaattcatattgattccaaattatgtttttctgaagtgaaacagtttactgaggaatttatgcctgaactgacagataagttggtgttatattccggcagtcagccattatttgatgtttatagcgttgaaaatgctattcaaacagctttaaatagtcgtgtaaacttaaaatccggtggctatctaattattgaacaaaccgaatctatgacaacgatagacattaatactggtgcttttgtgggtcatcgcaatttagaagaaactatttttaatacaaatattgaggcaacaaaagctattgcacaacagttacaactacgcaatctgggcggtattattattattgattttattgatatgcaaacggaagaacatagggatcgtgtcttggaatctttacgtttggcattatccaaagatagagtgaaaacgaatgttaatgggtttactcaacttggtttagttgaaatgacacgtaagcgaacaagggaaagtttggagcatattttatgcgatgaatgtccaacttgcagtggacgaggcagtgtgaaaaccgttgaaacggtttgttatgaaatcatgcgtgaaattattcgtgttaatcatttatttgccagcgaaaaatttgtagtttatgcctcaagagcggtggcggattatttaattaatgaggaaagccatggtttattagcagagttggaagtcttcattggcaaacaaattcaaataaaaacagaagtgtattattcacaggaacaatttgatgttgttgtaatgtaacttccatttttaatatgttatattgacctcatattcattattcaaggtatcggtatggttaagaatattggaattttatatattgcgacagggcgttatcacgttctttgggaagatttctataaaagtgcggaaaagcattttctacccgagttacctaagaaatattttttattttctgattatgagggaagttttttaggagaggaaagtggaaatgttcacagaatatatcaaaaaaaattaggttggccttatgatacgttgatgcgttttgatatgtttttaaaagagaaagagcgatttaaagagttggattatctcttttttgttaatgcgaatatgatttttattaaagatatacatcaaaatgaagttcttgcatccgataaagagttaattatgattttacaaccttggtttatcggtttagatattgataaaactacttatgacagaaatccgttgtccacatcgtatattccttatggggagggtgaacattatgttatgggcagttttaacggcggtaaaacgtctgcttttttagagatgtgtcagcaattaaatgacaatatctatttagatttaaaaaaggacattattgcactatggcatgatgaaagtcatttaaatcattattgttggcgaaataaagaaaaaatatttattttgccggacagttatttgttggatgaagggcaacagtacttcccaagtaaaaagtctcattatattaatcccttatatttaaaaaatcatgatgttcggttagttatgagaaataagaatcattataggttcggggggggggaattacatgagagggattactgatgaacggatcgaatttaattggtcaatttttttgttgaatttaaatgtgtatcgtctctatttaaaagagagaattagggctgtatttaaagttctttgtaagaactaatattgttaaggtaggacaaaaaaacaagatgttaaacaaagtacaagaatctatacttgctccaaataatttagaaccggataatttaaaaaatacatttgatatgttgtctcatcgccagattgattatgcagatttgtattttcagctcagtcaagatgaaaattgggtattggaagacagtattatcaaagaaggcggttttcatattgaccgtggcgttggtgtgcgtgcggtaactggcgagaaaacaggatttgcttattccgatcagattgatttggtcagtttacagcaatgtgccaatgcagtaaaaggaattgctttgccaaatcaaggtaatattattaaaccgattggctttaacgctgtaaatgcgattactcgttatcctgcagtaaatccgttaaatagtttgaataaagagcaaaaaattgaattattacatttagtagaccgtaccgctcgtgcatatagcccttatgtgacaaaagttgtagcgaatttaaccgctctttatgaagaaattttagttgtggcaacagatggtacgttagcagctgatgttcgaccgttaattcgtttatctattttcgtgatggcggaaaaagcgggaaaaagagaacaaggaagtgcgggcgttggggcgagagtaggacttgattggttctttgagccttataagggcgaacaacgtgcgatttattttgcgaaagaagcagcacgtcaagcattggtgaatttagacgctattgaagcacctgccggcttgatgccggtagtgttgggcgccggttggccgggtgtattattacacgaagctgtggggcatggattagagggtgattttaaccgtaaaggaagctcattgtttacaggaaaaattggggaattagttacttctccattatgcactattgttgatgacggcactctaccgaatcgcagaggctcgttgacaatagatgatgagggcgtgccaagtcaatgtaatgtattgattaaagacggtgtcttgcagggttatatgcaagataaaatgaacgctcgcttaatgggtgtgaaaccgactggaaatgggcgtcgtgaatcttatgctcatttgcctatgccaagaatgactaatacttatatgttagcggggcaaagtaagtttgaagatttaattgcttcggtcgattatggcatttttgcaccgcactttggtggtgggcaagtggatatcgtctccggaaaatttactttttccatgtcggaagcctatttaattgaaaaaggcagaataaccaagcctattaaaggtgcaactatgatcggacaaggaattgaagtgatgcaacaagtatctatggtagccgataatatggaaatagaccatggcataggtgtttgtggtaaagatggacaaagtgttccggttggcgttggtcaaccggcttgtaagatagagcaaattaccgtgggcggaaccgcttaattaaactatggtgaatttgtgatttgttagataattaatttttatagagaatatagacagtgactgaaacgactcaatcaaatttgcaattggctcaagcatataacgaactaccttatacttctaaagtttttgctgcttgtcaacctactcgtttacatgctttagctaagattaaagggcttttaccccccccccttagaaacagctaaggtgctggaaatcggttgttcttttggcggcaatttattgccctttgctattcgacaccctaatagccagttagtcggtattgatttatctgaataccaaattaatatcggccagcaaatgatggaacaggtcggcgtgaaaaacgtagagttggttgctgctgacattagccaagtgagctttaatattaagtttgactatattatttgtcatggtgtttttagctgggtgccggaagcggtacgccatgcaattttaaaaaccatccaagagtatttatctcccaacggtatcgctcatattagctataatacctacccaggctggaaaattcgagatgtcgctaaagagctgatgtgttttggaagcaatccgaatttaagcagtttggagcgtatagaccaatcttttgagttattaaaatttacctcttccattttgcaacgaaagaatgctgacttatataaagtattatcgcattcatttcaagaaatacctgataaagataaattttacgtggctcatgaatactttgaggattttaaccaacctttctatttcagggaatttatcagccaacttgaggcataccatttagcctatttaaccgatagttcttttcccgctatttattcagatgtgcattttgaacatgatgaatatgagaaagtgtgtgcctattttgattaccgcttggaagccgtagaacaatttattgatttcctgaataaccgctcttttagacacagcattattacccatcaacaaaatttggcggacaaagggattaccaataatatcagtcaatacaatcattgccatcatttctatgatatctatttcagaacagatgtgcgttatagccctgcgactgatgataaggaagcgcattggcagttgctggacataggtgcggaaatttcggatactccattaaataatttattatgtacttatcttcaagagcataacaatccttgtaaaattggcgatatttgtgagtatgccaaaaaattccccgaatatgacgaaactgaactttacaaattaattctttctattatttattctaatcatgtttatttatgttttgagccagaaacatcgaccggctatgacagcaaacccaaattgtttgagccgtaccgaagattgattgatttggtcagacataatcccaatgttaccggattgtccaatcgatactatcaggtactcaacttagatttcttgccgcaatatatcgcacaatttctcgatggcactagaacagtcaaggatttaatcaaacaattgcgagaggacattgaaaacaataccattgtccttcatgatgaaaacggcaatgaactttcgaataaaaagattaaagataaagacctcaaagaagtgattgttcggcaattggacgcactcaaggagtacggttatttcacggaatataaatagtactgtgtaaattgtccaatcgtgagatagtgtagggagcgtatttaatattgcattgaatacgctctatttgtttaaatttaaactttaaaatcaggtgctaaacaaggttggattttattgagtatttcttttacaagacgtggtgttgctgcaacgatatgactgtcagtgaaatatttatgaccaccgtagaaatcacatactaaaccaccagcttcacgtagaatcagatcacctgccgtaatatcccaaggtttaacgcccatttcaaaataaccgtcaacacgattagctgctacatagcaaagatcaagtgcggcagaacctgcacgacgaaaatcagcaacattttcagcaaggttgctcatcatagcaaattgggttggcatgagagagggttttttgaatggaaatccggttgccaaaattgcaccttgaaggtcacgtttactgctatcaacacgtaaacgtaattcattaattttcgcaccttcaccacgcacagcggtgaataattcattgcgaataggatcataaaccacgcctatttcagtgcgaccttttacacggacagcgatagatacagcaaagtgcggtaagcctttgacaaagtttgtcgtaccatctagtggatctattacccattgaatatcgttgttttgtccttcgtgagcaccgctttcctcagtaataattgtatgctcgggataagatttgcgaacaacctcgataattgctgcttctgaggctttatcaatattcgtaacaaaatcatttatacccttttgcattgtttgaatttcatcgcggcgttcataacctttaacaattatattacccgcttttcgtgccgcacgaatagcgatatttaacattggattcatctctttccaccagatttcaaagaacacatggggtgggattatagtgaattttgcctataaaagcgagtagattttaggtttcctaacggttttttagggatcaaataacttttcgtaaattataggggctatgctaaaatacccacaattttaagtaaggtaaaagtcttaatgttggaaaatatcaaaattgttttagttgaaacttctcacagtggcaacattggttctgctgctcgtgcaatgaaaacaatgggactaaatcaattatgtttagttgcacccaaacagggaattgatgaacaggctgttgcgttagctgcgggtgctgaagatgtggtaaaaagtgcggtagtggcggacagtttttctcaagctgtagcggactgttctcttattattggcacaagtgcaaggttaagacatttacaaagtaccttaattgaaccgagagaatgtgctgaaaaagtcatacaaagtttgtcatctcaaaaagtagccattgtttttgggcgtgaacgagttggactgacaaatgatgaattattaaaatgccattatcatttaactattccggctaatcctgaatattcttcattaaatctggctatggcagtgcaattaatcagctatgaacttagactagcttggcttgcctcgttaaaagaactgaaacaaccgttttctgtgatagcaaataactatccgacatttcaagaattagagcatttttttgcacataccgaacaactctatcaacaacttggttttattcaaaatcaaggggttatgaaaaaattaagacgtttatatcagcgtgttcaacttgaaaaaaatgagttgaatattttgcgtggtatgttaagtgcggtagaaaagcgaattaattgcaaaaaattagaagttgactaatttagtaggattagtaatatatccgctcaatgtggatctaaaggatattgagaatgaaattaacatcaaaagggcggtatgcggtaacagctattttggatattgcgttaaatgctgagcttggacctgttagtttagcggatatctctgaacgacagcatatttccctttcttatttagaacagctttttgctaaattacgccgtggtggtttagtgaaaagtgtgcgtggtcctggtggcgggtatcagttaggattatctactgatcagatctccattggcatggtaattaacgcagttaatgaaaatattaacgttacaaaatgtttggggaatggcgattgtcaggggggagtaaaatgcttaactcattctttgtgggaagaattgagtgtacgaattgaaaatttcttaaatgaaataacgattgcagaattagttgcaaaacaagccaagtgaaatgagcagtacacgtttgagatagtgataaaaccggctaaaagtgcggtacaagaaaagattttttaggagagagtaatgaaattacctatttatttagattatgcggcaacttgccctgtggatgaacgtgtagtgaagaaaatgatggagtttttaagcattgatggaaattttggaaacccggcatctcgctcacataaatttggttggcaggctgaagaagcggttgatgttgctcgcaatcatattgctgatttaatcggtgcggacagtcgtgagattgtttttacttctggtgcaacagaagcggacaaccttgcattgaaaggagtgatgcgtttctatcaaactaaagggaaacatcttattacctgtaaaactgaacataaagcgatcttagacacttgtcgccagcttgaacgtgaagggtttgaagtgacttatttagatcccaaatcagatggtttgatagatttagaggaattaaaatccgttattcgtgatgacacggttttggtttctataatgcacgccaataatgagattggtgtagtacaggatattgctaaaattggtgaaatttgccgtgaacgtaaggtattatttcacaccgatgcaactcaatccgtcggtaaattgcccattaatttgagtgaattaaaagtagatttactttctatgtccagtcataaattatatggacctaaaggtataggtgctttatatgtttgccgtaaaccacgagttcgtttggaggcaattattcatggtggcggtcatgagcgtggtatgcgttcaggaaccttacctgtacatcagattgtgggcatgggtgaagcatatcgtattgctaaagaagaaatggcaacagaaatgccacgcttaaccgctttgcgtgatcgtttatataacggcttaaaagatattgaagaaacctatgtaaacggttcaatggaacaacgtttaggtaataatttaaatattagttttaattacgttgaaggtgaaagtttaatgatggcgttacgagatattgcggtatcttccggttctgcctgtacatcggcaagtctcgagccttcttatgttttgcgtgccttagggttaaatgacgaattggcacatagctcaattcgttttactgtggggcgttatactacggaagaagaaattgattattctatcggtttagttaaaagtgcggtgaaaaagttacgtgatttatctccactttgggatatgttcaaagagggtattgatttaaacagtattgaatggactcaccattaatagaagagtttagcagtttgttgggtaggtttatcgcttacccattttaagaaatgagaaaaaataggaacgaaaaatggcatatagcgaaaaattacttgatcattatgaaaatcctcgtaatgtaggttcgtttgataaaaaagatccgacagtcggtagcggtatggttggtgcacctgcttgtggtgatgtcatgcaattacaaattaaagtaaatgatgaaggtatcattgaagatgctaaatttaaaacgtatggttgtggttcggcaattgcgtcaagttccttaatcactgaatgggtgaaaggtaaatctttagatgaagcccaagcgattaagaatagccaaattgctgaagagttggaattgccgccggttaaagtgcattgctcaattcttgcagaagatgcgattaaagctgcaattgctgattacaaagcgaaaaaagctgaatagttaaagaagattaaaggagtaatgaggtgcatataattttaatattaagccacattattccttttgtgtttagttccctttagttggatttatgtttagataggtagttaaatttctagcagttataatgagttgagaattaactatattgattaaggagaataaatgagtatcaccttaacacaagcagcagcaaaccgagttcgtacttttttagaaaaaagaggaaaaggaataggtttacgtttagggattaaaacgtcaggttgctcaggcttagcttatgttttagagttcgttgatgttttaaatgaagatgatgaggttttcgagcaagatggcgttaaggtgattgtggatcataagagcttagtctatttagacgggactcaactggattttgtcaaagagggactaaatgaaggctttaaatttagtaatccgaatgtaaaagatgaatgtggttgtggtgaaagtttcaacgtataggcaggcatatatatgataaatccatttgcgttatttgatttggaaattgattttaatcttgatcaacaaatactctcacagcgttatttaacgctacaaaaatctttgcatcctgataattttgctcatagatctgcccaagaacaacgtttagcactgcaaaaatctgctgaaattaatgatgctttacaaatactgaaagatcctatcagtcgtgctgatagtataatcaatttgcatcttggtgaacaaaatatagagcaaaaaactaatcaagatatgatgtttttgatgcagcaaatggaatggcgagaacggttggagcaagttgagcaacaacaaaatatggataagttattacacttctcgcaagaggtcgagtgtgtacaacatgatattttagcggagctacaagaatttctagcacaacaaaattggcaacaagctcaattgctaaatgatcgtttacgttttattaaaaaattatttgttgaaattgaacgggttgaagaacagttagctggtttttagctcagtaatttatttagaaagttatgacgagataatagagtatggcattacttcaaattgcggagccagggcaaagtgcggcaccgcaccaacataaattagctgtaggtattgatttggggacaacaaactctttggttgcagctgtgcgtagtggaagtagtgaagttttgcgggacgaacaggatcgcttgcttattccatcgatagttcatttaacagaagatcaagcgattgtggggtatgaggcaggtcaacttgccagtcaagatccgcaaaataccattatttccgtgaagcgtttaattggacgtagttgtactgatgtacagcaacgttatcctaatttgccttatcaatttagtgcaactgaaaatggcttacctctattaaagacaagaaggggattattaagtccggtagaaatttcagccgaaattttgaaaaaattgaccgcacttgctgagcaacgtttgggtggagaattaactggtgcagtgattactgttcctgcttattttgatgatgctcaacgacaaagtaccaaagatgctgcaaagttagctggtttaaaggtattgcgtttacttaatgagccgaccgctgctgccatcgcttatggtttggatagtggacaagaaggtgtgattgctgtttatgatttaggcggcggtacttttgatgtgtccattttacgcttatccaaaggtgtgtttgaagtgcttgctaccggaggtgataccgcacttggtggtgatgattttgatcatttattagcggagtggattgtaaaaaaatcaacagtcgcacctcaaaatgatcgtgaaaaacgtcaacttattgagcttgcaaaccaaattaaagttgctttgacctcgagcgataaaatccggatttcttatgcagagcaaaatctggaaattacgcgtgatgaatttaattctctgatttcaggtttagtcaaacgttcattattagcttgtcgtcggacgttaaaggatgccaatttaactccatcaaatatattggaagtagtgatggtgggcggttcaacgcgtattccttatgttagagaacaagttggtgagtttttccaatgtacaccgctgacttctattgaccctgataaagtggtggcattaggtgcagctattcaggcggatattttagtaggaaataagcctgatagtgaaatgttattgctcgatgtgattccattgtcattaggtattgaaactatgggaggcttggttgagaagattattcctcgtaatactactattccggtagcaagagcacaggaatttactacattcaaagatgggcaaacagctatgtcggtgcatgtgttacaaggtgaacgtgaaatggttactgattgtcgctctttggctcgttttactttacgaggtattccggctatggtggcaggtgcagcacgtattcgagtcacttatcaagttgatgctgatgggttattaagtgttactgcagtggaaaaatcaacaggagtacaagcatcaactcaagtaaaaccttcctatggtttaactgatgatgaaattgctaatatgctaaaatcctcaatggagcatgctaaagaagatattcaaactcgtttactaacagaacagcgtgttgatgctaccagagtcattgaaagtgtttattcggcattacagcaagatgaagatcttttagatgataatgaattaagtgcggttaaaaatgccttagtttcattacaaaaattgattcaagaagaagatagccttgctattaagcaagggataaaaatgcttgatcaagcaacgcaagaatttgcctctcgccgtatggataaatctattcgtcgagcattaagcgggcaacatattgaacatattaaataaaggaaagtagaatgcccaaaattgtttttttacctcatcaagatttttgtcccgaaggaatggttgttgatgctgcaccgggagaaaatctattagacgttgcacataatgcaggcgtggaaattcatcatgcctgtgatggctcttgtgcttgtaccacttgccatgttgttattcgagagggatttgacagtttaaatgagacaacagaacaagaagaagatatgttagataaggcttggggcttagaaatggatagccgtctttcttgtcaatgtgtggtcggagaggaagatcttgtagtagaaattccacgttataatttgaatcatgctaatgaagcggctcattgatccatttatatcaaggtgcatttagcaccttaattattatgctcaaattatataagttatatccaattattctctgctttttgagcgaaaattcagtaatatacaggctttattctcaagtaaaggggatataaatgaaaatccaacatttaattaagcaacatcaacttggcttattgtttcaacaaggctcctttggtttagaaaaagaaagccaacgagtttatcaagacggttcggtagtaacaaccgaacaccctaaatgttttggtaacagatcttaccatccctacattcaaactgattttgcggaaagtcagctcgaattgatcacgcctcccaataaaaatttagaagatagtttaagatggttatccgctattcatgaagttgttttgcgttctttgcctgaggatgaatttatttttccgttgagtatgccggcaggattgccttcagatgaattgataaaagtcgctcaattggataaccctgaagatgtggcatatcgtgaacatttagttcagtcttatggcaaaaataaacaaatggtcagtggaatccattataactttcagttggatccagcacttattcaaaccttatttaatttacaacaagaacaaaaaagtgcggtagattttcagaataatttatacttgaaaatggcgaaaaattttcttcgttatcaatgggttctattgtacttattatcagcgacaccaacagtagagagtaattattttaaaggtagttcgccattaggaaaaggtgaatatgttcgcagtttacgttcaagcaaatatggttatgtgaatgatcctgaggtcattgtttcttttgatagtttagaacaatatgcagaaagtctggagcattgggttaaaagcggaaaactgatagcagagaaagaattttattccaatgtgcgtttacgaggtgcgaaaaaggcgagagatttaattcaaaatgggattaaatatttagaatttcgcttgtttgatctcaatcctttcgagcaatacggtattagccttgcggatgcaagatttattcatcattttgtactattgatgatttggcttgatgaaatgccagatcaacaaggtgttgaactggggcgtagccgtctagcggaagtagctctagaaaatccgttggcacaaactgcctatcgagaagaaggtgagtggttacttaatcagttaatcagtatgttgcaaagtatcggggcagaccaaagtgcggtgagttttgtccgagaaaaattagctcaatttgctgatcccggtctgactttatgtgctaggttagtccaagaaattgaacaaaagggcggttatcaaaaattaggtgcagagcttgccaaacaatataaagcaaatgcttttgagcgtttttatgcgttaaccgcttttgataacatggaactttcaactcaagccttaatgtttgatttaattcagcaaggtatcagttttgagatcttggacgaacgagatcaatttttacgcttacagtttggtgaacatgttgaatatgtaaaaaatggtaatatgacttcacgagacagctatatttctcctctcattatggaaaataaagtggtcacgaaaaaagtattggacaaagcgggatttaatgtgccacagagtcaggagtttacttcagttaaacaagcgatagccggttatagcctgtttgaaaaaagagcggtcgttattaaacctaaatctactaactatggcttggggattacaatttttcagcaaggtgtgaataatagagaagattttgccaaggcagtggaaattgcgttccgtgaagataaagaaattatggtggaggattatttagttggtactgaataccgcttctttgtgttaggtgaggaaacgctggcagttttattacgtgttccggcaaatatagtaggcgatggcattcatactgtggctgaattggtagctcaaaaaaatacgcatccattgcgtggtgatggtagtcgtacgccattgaaaaaaattgcattaggcgatattgagcaattgcagttgaaagagcaaggtttgactgttgagagtattccagctaaagatcaaattgttcagttgcgggcaaattctaatattagtacaggcggtgacagcattgatataactgatgaaatgcatttgagttataaacaactggcggtggggattgcaaaagctatgggggctgctgtgtgcggtgtggatctgattatttccgatttgaaagaaccggcacagcctgatttaagttcttggggcgtaattgaagcgaattttaatccaatgatgatgatgcacatcttcccttatgccggacaatctagaagattaacaagaaatgtgattaacatgttgtttccggaagtaaagtaaataatgtttttcgtaaaataggcggtttttagactgttaatgataagggctggtagtttaccgagaaatttgatttgctagtgtaatggaaaaaatggttgctaataatatatttttgacgttattagcaacgattttgtctattatgctactgcttatggtaagcaattatagcgaatcccccaacaaaacagattctaatgcaatttcgatcatttcattgaaagttaattgtcgctcttctgcactggtttgttcatgcgtacggatatgatcagaaacagtacagattgttaaggctttggctttaaattcagctgctacaccataaatgccggcagcctccatttccacacctaaaatgccatatttttccatgacatcaaacatttctgggtctggcgtataaaataagtcggcggaaaacaagttacctacttttacatcaattcctttattttttgcagcctgtacggctgcttgtgccatgccaaaatccgcaatggcagcgaaatcgttatctttgaagcgaatacgatttacttttgagtcggtacaagcaccaagaccaataatgacatcacgaattttgacatccatgttgaccgcaccacaagaaccgacacgaataattttttttacgccatattctgtgatcaattctttagcataaatggagcaagatggaattcccattccatgtcccatcactgatatttttcgtcctttgtaagtacctgtgtaaccaagcatattacggacatttgttacttcttgtgcattttctaaaaatgtttctgcgatatattttgcacgcaacggatctcccggcattaaaacaacatcggcaaatgcaccggatggtgcgttaatatgtggtgtcataaatgtttccttttgttgattaaaatattatttttccttaaagcaataaagcaatcgttttcttttacctaaaatgaacacaccacgaaaggtcatggtgtgaaatatggatgacggaattaaaccgcacttttacagtgcagcaccgcttaatccaataaatagacctgcaattgttgcactcattaagtttgctaatgaaccggcaattaccgctttaatacctaagcgagcaatatcaccacgacgatttggtgccattgcccctaagccaccgattaaaattgcaatagagctaaagtttgcaaatccacagagggcaaaagtaataattgctttagttttatcacttaattgcaccgttgcatcagctgcaaggtatggtacaaaatctaaataaccaacaaattcattaattgctaatttggttccaatcatacgaccggcaatttccgcttcttcccaaggaaccccaataatgaaggctaacggcttgaaaacccaaccaaagatcatgccaagagaaagtccttcttgaccaatccagtttccgatagtgccaagaattccgttaagtaatgcaattaaagccacaaatgcgatcaacatcgcacccacatttaaggcaagttgcataccagatgatgcacctccggcggcagcatcaagaatatttgttggtttttcttgttgtatttgttcgaaattatcattaaatttttcagtttgtgggataagaattttagcaaataacaatccggctggagcagccataaatgaagctgcgattagataggttagaggtacacccattccggcatatccagccatgactgaaccagcgatagaggctaaaccaccgcacattactgcaaacagctctgattctgtcattttgctaatataaggtttaatgactaagggggcttctgtttgtcccacgaagatattggctgctgccgacatagactcggattttgatgtgcctaatgctttttgtaatgctccaccgatgattttaatcagccattgcattacaccgatatagtaaagtagggagattaatgcggagaagaaaacaatatttggaaggacgttgataacgaaaacaaaaccggctgatcccatagaaccatcggcttgtggtgctaacccattaaatagaaaacggatcccttcattaccataattgatgaccgattgtactgctcctgcaacgctttgtagtacctgacgaccaacgggaacataaagaataaatgcaccaaataaaaattgaattaatagtgcacctagcactgtacgataattaatcgccttacgattattagataaaagaaaggctattaataataaagcgaagataccgataatgctaatcagagaactcataatgtgaatatccttataggtgtgttaaaaatgcacgtattctactcggttttatataaaaaatcttgtactttctaagtgagttatagcttttttaaatttataaatattctttgttttggattaaatttaatttcgattatgattaacacaacgcaactgttgggtcgtaataatgaaaaaatttaatgagcttcctcaaactccttgggcagccaaatctttgtgggaaatagaaacaaaatcgctattggtattatgtttttcactttccttgctcggtattggtgatggattgttggttttatctaatttaggctctgcaccttggacagttttgtctcaaggcattgctttacaagcacaatttagtgttggctgggcatcatttatagtaagtatcttagtaatgttaatgtggattccgttaagattaaaagttggttttggaacaattctgaatgttgttctgatcgcattatttcttggtttaagtacattttatatttctccgccgagttcccttttagcaaggttttgctatcttataatgggtattattttttttggtatcggaaccgcattttatttgacttgccatcaaggggcaggacctcgagatggattaatggttgggttatgtcatcgctttaaattaagaataggaatagtccgtactcttatggaagtttctgtttgttttttgggttttttgctaggcggaacagtaggaattggtacactattatttgctaccagtattggttggattattcaattaggggtttattttattatgaaacttaacaagtcggtctaagaaatatggcattattgccagtcttaattttaaagcatataatctttgccattttattctatatctaaataaacctatgatgagattaccaatcagcgtcacaatgcttgtgaaaaatgccgagaaatatttggcaaaaagccttagttctttgaaagatttccctgaaattattgtgttagataatggatcaacagatcgatctattgaaattgcaaaacaatttactaatgtcaaaatttatcattcacctttcattggttttggaccgatgaaaaatttagttgcaacttatgcaagttatgattggattctaaatattgatagcgacgaaattttacaaccccagcttattcaagagatttctcagcttaatttcgatgaaccccgcaaagtttacgcattgttaagaattaatcattaccgtggaaagccaataaaaacttgtggttggtatcccgactttgtgaaacgtttatataataaaaagttggtaaaatttgatgacaagcgagtgcatgaggcattagagattgcagatgatatacaggtagttcgcttaaagcatgaatttaatcattattcttttgatagtagtgagatgttgattaataaaatgcaacattacaccgctctttttgcggaacaacaaaaatatagaaagaaaagtagtgtattgtcagcaattgctcatggaatagttgcatttttcaaaagttatatattaaagagagggattttatcaggaggcgatggttttattatttcttttgccaacgccagcggttcttactataaatatattaaattaatggaagctaatcagagtttaacaactgctttaattataacaacttataatcgcccagatgccttagaggctgtgttagtatccgtattagcacagagccttttgccgaatgaagtaattatcgctgatgacggctcaacagaagataccaaagaacttattcaaaaatatcaagcaatttttcctattccacttaaacatgtttggcaaccggatacgggctttcgtttagctgaatctagaaacaaagcattatctttagttgagtcagaatatgtaataaccattgatggcgatatggttttacatcctcaatttatttctgatcaccgtaaagcggcagaaaaaaatgtatttgtggggggggggagaatattgctcactaaggataaaacgaccgcacttttacaatcatcagaacaatattcctcttttaaatggtatgaaaaagggcttgaaactcgttttgaaaaacgtttaatggcgttgcatattcctttcttgtctgaatttatccaaagaaataaaaaagtgcattattataacgggataagagggtgtaatatggcattttttttatctgatgctttagaaattaatggttttaataatgattttgttggttgggggcgtgaggatagtgaatttgtcgctcgtttttttaataatggaggaaaaagaaaaaacatcaagtttgcagcgattgcatatcacttgtggcatcctgaagaagatagagaagccttgccagttaatgatgaattacttaaacgagcaattgaagataaattggttttttgttcaaatggattgaaccaaattaaattggattaaatattattctttatatttttgtaacgcacttttcagcagggagatgtaaatagacttgctttttagctaaaaaagagtacaatcttcaggctttttgtctatatatacagagaaaaaagtaagcattcccactcttttgatgtgggttttcttttagtttaaattagttagaggaaggttatggtaaccattcgtttatctcgtggcggttctaaaaaacgcccgttttatcaaatcgtagtagctgacagtcgttcacctcgtgatggtcgtttcattgaacgtgttggttttttcaatccgttagcatcaggtaatgttgaacgtgttcgaatcaatttagatcgtgtgaatcattggattggtcatggtgcatctttatctgatcgtgttgctagcttagttaaagaggctcaaaaggcagcttaattttagcgattttataggtgaatgaaatggaacaacaaagaatagaagtcgttggaaagttaggttcaacatacggaattcgtggttggttgcgtctttattcatcaacagaacaagctgaaagtatctttgattaccaaccttggtttttaaaaatcaaggggcaatggcaaccaattgaattggaaagctggaaatttcataatcacgagttaattgttaaattaaaaggcattaatgagcgtgaggtcgcacaaactctggcaaatgttgaaatcggagtaaatttatccgtttttcctctattagatgagggggatttttattggcatgatttaatcggttgtcaagttgtgaatctacaaggttatgcaatgggtgttgtgtctgaaatgatggaaaccggtgccaatgatgtgttggttgtgcgtgcaagtacaaaagatgcttttggtaaaaaagagcggttgattccgttcttatatgaacaagtagttaaaagagtggatctcagttctaaaactattgaagttgactgggatgctggtttctaacctcaggtaatctgtaacgctttggcagtaacataaacacagaaggtaagtaaatgtggatcgggattattagtctatttcctgaaatgttcaaagctattacggaatacggagtaacaggacgagcagttaggcaaaacctgctggagatacaatattggaatccgagagatttcacctttgataaacataaaacggtagatgatcgcccttatggtggaggaccgggaatgttaatgatggtgcaacctttgcgtgatgccattcattgtgcaaagtctgtggcaggtgatggtgtgaaagtgatttatctttcgcctcaaggacgtaaactggatcaaaatggtgttcaagagcttgccagaaatcaaaaaatgatttttgtttgcgggcgttatgaaggcattgatgaacgattgattgaaactgaaattgatgaagaatggtcaatcggagattatgttcttaccggtggggaattgccggcgatgacgttgattgatgcagtcgcaagatttgttccctgtgttttgggtaaacaagcctctgcacaagaagattcttttgcagaagggctattagattgcccacattacacaagaccggaacaattaaacggtttaactgtacctcctgtattgatgtctggtaatcatgaggaaattcgtaagtggagattaaagcagtctttgcaacgaacatggttaagacgacctgagctattggaaagcctagctctgactgacgaacaaagtaagctgttatcgcagattaaacaagaaaacagttaatcagttaaatctaggatctaagaaggattactacaatgagtaatatcattaaacaaattgaacaagaacaattaaaacaaaacgtacctagcttccgtccaggggatactttagaagttaaagtatgggtagtggaaggaagtaaacgtcgtttacaagcattcgaaggtgtggttattgcaattcgtcaccgtgggttacatagtgctttcactttacgtaaaatatctaacggcgtaggtgttgagcgtgtattccaaacacattcaccaattatcgacagtattactgttaaacgtaaaggtgcggtacgtaaagccaaactttactatttacgtgagcgttcaggtaagtctgctcgtattaaagagcgtcttggtaattagtttattagacttatataaacaaccccttggatactccaaggggtttatttatagaaagattggcacgttttgaccttaaatcataaaatccaaccattaatagaacattaagtaatatgatgaatgagcacatattacaataatgcaaaatgcaaaaattccacaaaatgatctgcccagtgtttttcatggtgaatttcatttgccatcattcgtaagcgaatgttatctaatggatgacctgtgcgtaataaggcttggtaataatggagtgtgcaatcaatataggcttggttcatatttgaaataaataatgaatcaacatcatctccttctttagtgcctacttgaataaagactttactatttttatcaattggattgtggtggataaaatgcagaaaatctttttcactaaaccaagacgcgagagaaaaaacacctaaatgtccaaaaatttgtggatatgctgaccccatataggcagtgataattcctcccatggaactaccggcaagcaaagtatgttctttttgtggtttagtgcggtaatgttgatcaatgaatggtttaacgatctcaactacccatttgccgtattccatacctttcccaccgcattttttaatttccggtgacgagcctacgtcagtacgccaaggtccatattcatcaagacgatctacacctgaattatctatgccaacaataataattttaggaaattctttatggtgtttaatggttggaataattttccaagagtaacctgagtaagattctttactataaaaaatattttgtccgtcatgcatatagagtactgcataactatcccacgtatcggtgtaataatcttttggcaataacactcgaatacgacgagtgcggttatagtagggaacataaagaaaatgttcttccatttttaaataataattagtatttttcacaacaaaaaccttataaacgtaaaacaaagtgattttttaaatactttcacctaaatgaatattatatccgagattgatcatgtaattttcaggtgcaataccttctatacgattaagtaattcttttgccgctacttcaccgatatttaagcgtggtgtgcgtacagtggcaatttgtgtcgttaaagataatccaacatttaacccatggaagcctgcaataccgatttctttaggtacgtcaattccttgacgttgacattcaaataacgcaccaattgctaaatcatcattggtacaaaaaatgccatcaatttggggatgtttttttaatgccagttttaattgttccgcacctaaagtaaatgatgatggttcttccgtgaggagactgtgaggtgtcagttgatgttttttcattgcttgttcgtaaccctgcatttttaaacgggtacgtttatccatacgagcagagaaatagacaatatttttatagcctcgtttaatcattgtttccaccatagactgtgctgccgctatattgttgaaccccaccacttgttgtaaaccgaattcgctggtatccataatttcgacaacgggaatatttgccacatctaacatttttagcgttcttgccgaatgttctgtttccgacaaaataagtccatcaatgttataagagagaagcgattcaattcgtttttcttctttttcttgacaataaccataatgggctaacatggtttgataacctgcttgatcggtaatattctcaatacctttaattacatcggcaaaaacatgatttgttaaagagggtacaagtacaccaatcgctttgcttttcgcattggataaaatttccggtgcacgattaggaatatatccgaagtgttctatagcttcggcaatacgcacacctgtttttggtgcgacaagacgtggatcacgcaaataacgacttatcgtcattttagtaataccaagatgagaggcaatatcttgcaaagtggggcgtttacgtttatcgggcattttttatcctaacataactttatttctgtccattttgccagcaatatgcctgttgcaacagaaacattcaagccgtgttttaatggattaactaatgacaaattaatcagttcatctgctttatccgctaatgattcagtatcagcttcactcagtacaaatgcaactttatcattgagttgtaattgcttaatggttttggcgtgtttatttgagcttagatgaacgatttgatagcctgcttgtcgcaatttaaccaatgccgtttcagtgcgatcaatttccagcggatgaatatattccataccgccttctgccactcgcattgctactgcagaatgaagaagttcaacatcgtcaataacaaccgcacttataccataacatacacaagtgcggataattccgccaatattatgtgcattacgcacaccatttaaaaccaataggcagtttttttggtgtggaatatctaaatagccgtgcaaagtaaatggacggcgttttttgaccaacatgcaaataccaccatgatgttcagtgccgctgactaaggctaactcgctattatctactacatgatagacttttttattgctggctaaatagctaaacaaatcccccactttatgtgccatttctaccgtagtccaaacacgcacaatactttccggacgttgtgcaaaaagggataaacaagcattttcaccatatactttcatttcctctgcacgatttttcttgatcttctccggtgcacgtggcgataaagggtcagttttcttttcagtttttgcaactaaacttgaacgttttagcacaacttgtacttgtcctgtaccgtttggcttttccatagtggtattgataatatgagtgtgggaagccgtattttgtgtatttttagggcgagagtgccgattggataaagctcgctttgagttattgtcaacgtgcggtgattttgatgtagatttttcatatcttttgttgctgacaaagcgttcagcaaagcgtttttcattatttgcttgttgaaaaattggtttttttgtcttcatgttggatattaatttaaggttagaaaaagataaagtgagcaaaaaaacaccgcactttatagagttttgtgaacattataacgaaaaaataccttttttctaccaagttaccgactaaatattgtaaactagccagccaaacacaaactcgtagagaagtgaattatgttgatcaataaaacaaaacgggcgaaacaaaatttggagcggttaccttgtattcctttgcaagcagagcaagttgagtttatttatcattcttcagattttaaacaacagattattcagtgtattcgtcaagcaaaatcaagaatttatttcaccgcactttactggcaaaacgacgaggcgggacagcaaatcctagatgagatttatcgtgctaaacaggcaaatcctgaattagaggtaaaaattttggttgattggcatcgtgcacaacgtaatttacttggtgctgagaaaagtgccacgaatgcggattggtattgtgatgaacgcagtaaatatcagttggcggacgatcctaatatattttttggtgtgccaatcaatactagagaagtattcggtgtattgcatattaaggggtttgtgtttgatgatacggttttatatagcggtgcgagcattaataatgtgtatctacaccaacaaacaaaatatcgttatgatcgttatcataaaattgaacataagagattggctgatatcttagtcagctttgttaagaattatttattcgatcctaatgtggtttatccgcttgattccggtgatcgtcctaaaaccaaagaaattcgtcagtatattcgtaattttcgtaaatatcttgccagtgagggacagtattatgtggaatcttccgtgaccttaaatgacagtttgacgatttgtccattatttgggttaggtgcaaatcataatttacttaatcaaaccattgaagatttatttcaagttgttgaggataagttaacaatttgtacgccttattttaattttcctcgtttattacagcaaaaagtacgccgtttgctggctaaaggaaagcaaatagaaattattgtaggtgataaaacggctagtgatttttatattcctccatcagagccttttaaaatggcgggagcattgccatatctttatgagaaaaatttgcgtcattttagtaaaaaatttaccaagcaaattgaacaagggcagttagttgtccggatttggaaagatggtgaaaacagctaccatctaaaaggcatttgggttgatgattgttatatgttgttgacaggaaataatttaaatcctcgtgcttggcgtttagatgcggaaaatggcttatttatccatgatccgaaacaacaattacaagcacaaattcaacaagagttgacctatattcgccgaaataccactgttttaaaacattatactgagttaagtgatctgactcagtatccgaagccggtacaaaaaatattgaaaaaatttgcccgcattaaagcagataagttagtgaagatgattttgtaagggttattcaaagcacttcatttcaaatattaaccgatagatcggcgataaatttcgccgatttcttttgaactcttaccaaacaccttttctaattgtgccaaaaaaagctcaccggcagatattgcatcaataagtgcattatgaccgatatattcgggcaaattatatttattacgaatatggctaagttgataattattttcgttgtcctgacataacgaacgttcaatttttaaggtatctaaccaaaacagaggaaattgcgataaattatagcgaacgttcagataatgtaagataaaacgcttttctatagtggagccgtgagcaataagaatacgtccttgcatcagctcaaagagtttattcattgtatcatctagggtttctgccccatttagcatttgtggcaaaatatgattgataataacagtatcttctttaatttcttgttgctcggcgacgaattgatgccatgcttttgaaatatctaatgttaaattgtcaatgggaacggtagcgacactcaaaatattatccatcattgaattcagccctgtggtttcgaaatcaattactaagtaggaaagtgcggtcaaatctgtggaacttttagggtaaggcttttcaaataaccttttccattgcacgggtaaattatcttgattaataaagatttttcgctgtttttccaatttattcaacggatgaaatttgttgaggaaattttttatcatctcattattcctcgttgtgaaaaacgtatctctgccgcctcttgaaattgggcaattaagcgaaaagcatctttaagatgatttcgttcaagggcacttaactcactgggatcgatatgattagttagttcttgctgttgttgcaatgcgtctgattgatatttaaaacgcatattgcagacaaattgatatacctccagtgcattattaagggtttctttattcagaataccttgcttgtaacaatgtctaaaacgctgttcagttgacatagtttgtgctaaaccggcagcaagtgcgtaaattcgtgcaagatctactaataaactgatagcacgttttttcaagttaagtttatttttatgttcaccttctttaataagaacaaaatttcggaaaatacttaatgggggttttactcgaatactgtttgccactaagaacgctaaaaagcgtttattgtgtgcgactaaatcgacaaaatattgctgaagttgatctgccaaattaagatcaccgtaaatacctcgcatatccataaatacagaagcattgagtaaaccttctaattcaggtgcaataatccaactacggaaattttctttccattcctgtagagaaacacaccagcgtgcatttattgccatatagttacccgtgcagtaaggatagccgcattcatgcaatccattgtttacaaatttagttagttgtacaaaatattcctgttcaagtgcggttaattttctttctaaaatgattgcattatcctgatctgataaagggtgcatttcataacgagcctgtgaacctgctacaacccaagcatagcgacagggtggagttcctaattcatgttcagccatcatgagcaacttacgagcaaatgcatcagcgataagcgtcatcacgtgcataatattattataagcgacacctctctctagtaaagcacggaataaatcccgttgctgtttagctatttctacaagcaaaggcagcgtatttgcttgaaaaatacggttaatgataaaaacagattgcatactgttttgttttacaagatctgtggcggttaaaataccttgaactttatcatcaacaatcaccggcaagctacgaatattatgttgcatcatcatggaaatagcttgtagtactaattcatcaccactaatcacaggaggattaatgttcatgatttctgtcactaacgtatttacatctaagccttgtgctacaacttttttggtcatatcccgatcatgaataatgccaatcaatttgttttgttgcatcactaaagcagaagaacggcgttgttcacacattctaatcgcagcttgttgtaatgtcgtattcgtatcaacaagagcaattttaggattagcaatatcaatcacttttttcatgaaaatatcattttgattttttaaaaagttattttttgccaaactgtttagtctttttcctgcatcagaagaaaagtaagaagcgtactcaggaaatttttttaaaagttcatttaagcgttgaaaaggaatttgataaattaacgtattttccaacgcataagcctgatatttatcttgctcgtgatgattgaaaatactgaaaccaaaacaatcgccactttccaatcttgctcttaattgtcctgatttattgacttgctccactgatcccatacgcacaatatacaagttttcattattattgaggctatcgatttcatcatttgtgattagttcccctttggggatataacgaatttcaatattctgtgcagcaagacgaattaaatcatgaggtaaatgtgtaaaagggggaacctgtgcaataaataattcgatattgggaataagtgagctatccatgtgagacctttgttttatcgaaagtgagctacaactatagcagaaattaacccgacacagctgcatcgggctaattacatttagtatttttgagaagataattagtttttacgatttttccataatttaattaatcttctataacgctctgaggtttctttgatgagttgctcatcatcaattttaccagctaaccaatcagccgaaggttgtccaaaaattgttctgcctacagcaaacccttttactaaaggtgcgtttgccgatgctttaaacacattctcaaagactgcttcaggtgcgtctaagccaaggattaaaataccacgacaatgtttgtcatttttttcaatgacttgactgatgtctgcccaagtttttgcggacactccaggtaatttccaccaatccggtttaatgccgagagaatagaagtgggcaatcatatcggtgtagtaactttctttttgctccatatccgcaggcaaaatgatctccagtaataattcgtgacctgtacgacaacaagcacgataaacttcttttaatgttgcatcttgatctgcttttaactctgccttgtctgccggatgatagaatgctaaacatttaacgacatgttctgcgggccaactaatgagttgactacctaaatcaccatgctctaaacgcaatggacgagaagatggcatttctattggacgaccaatccaccattttttaccagtaatttcattgagtgcttcttgaccaaatgtggtatcagctaaaacgccggcattgccattataaatcccctctttttgagcggtttgttctgcggctttaagcaataacgttttgagtgttggaatacgtttcaaatctgcaccgcacttttcagccatatcaaccaattgtttacgatgatcaaaggcaaaaatacataaatcatgccattgttgcttgcgtgttgtaacacggtgtaaatggtttaattgttcgtctaagtccggtcgaggtaccgattccgcacgggagagataattatctaattcttctttagtcggcattgccggggcacaaccatggcgagagacgaccaacgcaccgcaagcatttgcataacgacaacattgctcccaactttcaccgttaatatagccacgtaataaacctgacataaaggcatcgcctgcacctaagacattcaaaacttcaacacgtacgccatatacattaataccaccgtcaatatgattcggaatatcgccctcaaagacagaacaacctaatgccccacgtttgcaaactaacgtagcgttactgactttacgtacattttttaatgcagttagcgtatcagttgacccaccagcaatatgaaactcctcttctgtaccaactaagacatcaaagtgatgtaaaacttcttgtaaagattgtgtaacggcttcagagtcaataaaacgagtttcaccatcacccaatgaagttaatccccaaagtacaggacgatagtcaatatccagtaaacgttttgttccattacgacctgcgtattcaagtgcggttaaaaccgcatggcgagtttttggatgggataaatgcgttccggtaatagcaagtgcttttgccgaagcaatatattcttcatcaaaatcatcagcggtgattgccatgtctgcacaattatcacgatagaaaattaatggaaaagtatcttgatcttttattcctaaaatcactagagcagtcagccgctctttatccgtaatcaaatggctcgtatctacacctagacgctgcaattcctcacgtaagaaacgtcccatatgttcatcacctacacgagccaacatagatgattttacaccttgtacagctgttccataagcaacattacctgatgagccgccgagatatttagcaaaagagctcacatcctctaagcgtgaaccgatttgttgagcatataaatctacggcaactcgtccaagacaaataagatctaatgttttttcttttttcattgtgcttctccttgcgtgatgaagtcatcacaaaaaacggatatagaataaattatcgccttaaattgaaacatatatttcaaaaatgtctagaaataaaattaatatttgagatattgatcacaaagattagctatctcgctggtatataaagtcttttaagtaaaataagaatgaaatttccttttcaaagtggtataaatttaacttattactgagagaaatacaaaggaagagatagtatgcaagaacattctcaactcgttacattacaaaatgaaatccgttcacgttattcgactttgagtaaacgtttgaaacaggtagcacaatatgtccttgataatcacaatagcgtaatttttgatactgttgcgacgatatctgaacgtgccggtgttcctccttctacgcttattcgcttcgcaaatgcgtttgggtttagtggctttaatgaaatgaaacaaatttttcgtgaaaatttgattgaagaaacggcgaattatacggagcgtttacaagttttccgtcagctggaaccggaaaagagcgagcaacataatctgcaagatattttgaatatttttgcacaagccaataatcaagcactaaaacaattaagtagccaaactaccacaaaacagttaaaaagtgcggtagaaatattaaaaaatgcacagaatatttttatcattggattaaaacgttcgtttagtattgcctgttatttggattatgtgttgcatcatttagattgccgttcttttttaataaatggattaggcggtatgtttgatgaacaattaatgcaagtgaaaaacggtgatgtcatcgtggcggtgagtttttcaccttatgctaaagaaacgctggaaattgttagtgcaacctcacaaaaaggtgtcaaacatattgctatcactgatagtcaaattagtccattaattgcctccagcgatgttgcttttgtcgtgaaagaagcacaggtaagcggcttccgttcacaatgtgctacgatgacattggtacaaactttggcgattttattaggcttagaaaaagagaaagaaacacaaaattcttaaaaataacgattaagacttggtgataaatgtcagcaactaagttttgagataaatatcaaaacgatgatttttggtttggtgactgaagtgcggtgttttttttgcaagaaaatctgcgtaatcgggacgctttactaccgctcttttttgtgcgagcaataaggcaggttctaataacatatcagcatccaaatctgcaccgattaaatgttgaaaaatacgcatttcttttttaaccaatgcacttttttgtttatgaggatacatcggatccaagtagacaacatcagcaccttcttcactcgaatttaattcttgaatatgtgctatgtccagcaattgcatattcgcctgcatcatagtccctatttctacatcggcataagcacgcttcaagccgtcttgtaataacaaatggactaccggatggcgttcaaccaaacggactttacaccccaaagcagccagcacaaaggcgtcacgtcccaaaccggcagttgcatcaataactgtcggtagataattacctttgatccctaccgcttttgccacagcttcacctcgaccgcctccaaatttacgacggtgagccattgtgccggtcacaaaatccacataaacagcaccaagtttcggctcatctaatttgcgtaattccaagcgaacctgtccttccacttttgtttgcaccagtgctaaataactattaggatcgtgaatcaaacctttttgttgacaaagtgcggtaaattgcaccgcactttctgtttcacaaattaattggattttttgattaaccatacaccactttccatatgctctgtataagggaattgatcaaacaaggcggctttttcaatacgatgagttttagttaattcttgcaaattttcacataatgtatatggattacaggatatatataaaatccgctcatagttttgcactaattttaccgttgccatatcaagtcccgctcttgggggatcaacaaaaatggtattacattgataatcttgtaaattaatgccttttaagcgattaaatgcacgcacaccgttcatagcttgcgtaaagtcctctgcggacatacgaataatgtgtaaattatcaattttatttgctgcaatattaaattgagccgcacttacagagggttttgcaatttctgtcgctaatactttgcgaaagttttgtgctagtgcaatagagaaattgccgttcccgcagtaaagctcaagtaaatcgccctgactatttttagtacaatcaattgcccatttcaacattttacaatttaccgttgcattaggttgagtaaagctgttttctacttggcgataaatatactgttgatttttgacaggcaaaatttcatcaacaaaatcttgctgtaaacaaattttttgtttatttgcacgaccaataatttgtacatcaaatccttgttttatcagttgttgtttcaattgagttgctgcctgtagccattcttcgttaagtgttttatggtataacaaactgacaatgatcttgttgctcaaagtactgagatagtcaatttggaataagcgatgagttaaaatattgtgttgtttaagcaaaggcaataacgccagcatcatttggttaatcaactgactggcaataggaaattgatcgatacgaaaacgttgttttgttttttgatcaaacataatatgatagaaatcatcttgttcatgccaaatacgaaattcggcacgcatgcggaaatggcttgtttcggaagcaaatacgtcaagcggtggtgaattaaaaggtgctagaagtgcggtcagcttttgttgtttttctgctaaaagtgcggaatattgttcaataggtaaacgttgcatgatcttcagtattgagctaaaaatgaaaaggtgcgaatttcgcaccccttttacttaatcttaagttattcggcagagaaatcatccggattgtcagcaccaacaacgcctgataatgtgtaaacacgtttactggcagaaatacgagtgcggtatttattccaagttttctcaaaatatgtttctgccgggcgttctccacgacagaaagcaacgaaagctttttcttcttccgtaactggtacacgctcacctaaatctaacgctttaaatgcttgaccatattgctctaacgtttgagattcacgaatggtgtaatcaccatgacgagcaaaacctcgtggataatttttatcatcgaaaaaacgacgtgtaacactaaaactctctgccataatatcctctatcttattttgtaaaaatcggctcgcattaaatcaattttttgttatttttgcaataaacctttaacagtttctacataatccttgataaaaccgtctgttgtacgggataaaccttctgagtttactttatatttaccgttaatataaaattcaggtgttgctcttacgccaagtttttttgctaaggcaatttgtttgtttgtttgagcggtgacggcaaaactattaattcctccgtcaaactgtgccgcagtaataccgtttgcgagaaacacttcacgaatattgtctaaagtaggtgcttttcttttttcaataatcaattcaaatagaggcattttaactttttcttctatgcctaagagaattgctaatgaccaagcacgaacaatatcttcgcccatccaatcaacatgatattgtttgaaagtgacatctttgggcaaatcagctttaatttgttgtggaatttgatatgttttttcaaaattaaaacaatggatacaaccaaaagagaaaaattcaatcacttcaggttgaacggaacgaggctgctctagttcaatatactgttttccttcttgtaatactaaggcttgagttgaatttaaaaagaaaaaagaggctaatgcccatagaaattttttcatgtaatactcctaatcaataatgccacgtgcttttaataaggctgttttaaaatcgtcttcataatcttttttgatgccgggaataggctcatttttatctgtaccatacatttttaggtgataaataataacctcgtcggttaattccgcaatgggcttatcaaaaccggtttcctctgcaattttttgtaaaacttggattaaatgtaaatccggattgttagaccaatagggctgtaaaagttccaacacttcgtttaaacgatgacatttcataaagttttccttattatttaacccaaacagccgacaatcatacttgaaataggtaaagaagaaaatatggcaacaacaattagtgcagtaattttagctggtgggcaagctaaacgaatggctgggttagataaaggattacaactgcttcaaggtaagcctctctatcaacattgcttgcaaaggttaaccaatcaagtgagtagtatttctattaatgctaatcgtcatcaagctatttatcaacaaagtagggtagaggtttttggtgatgaattggaggattttcaaggtcctttaagtggaatattgaccgcacttgagcgagctaatacggattttgtgctttttgtgccttgtgatagcccttttttgccgttgaatttatgtgaaaagttgcaaagtgcggtggagaattcgaaaagtttattagcttatgcaaatgatggtgaacgtgaacatcctgcttttagtttattgtccactcaacttaaattaccgttaagagcttatttgcagtccggtcatcgtcaaatgttacaattttttcgtcaacataagggtatttctgtggatttcagcttacaaaaacaggctttcgtgaatataaacacattgcaggatattgaaaaatatcaaaatatttatgcttaattttttgttttaattattaattaccttaatttgatcataaatatatgaaaaatcattttttttactaagcaattagagtagacttcccctccgttgatatattacataggaataaaaaatgttaagcaaacaacaatcattaaaagaactcacatttcgaggaatgttattgggggcgttgatcactgtggtatttacggcttccaatgtatatttgggtttaaaagtagggttgacttttgcctcatcagttcctgcagcggttatctcaatggcagtattaaaatttttcaaggggtctaatattcttgaaaataatatggtacaaactcaagcatcttcagccggaacattgtcttccgttatttttgttatccctgctatgttgatgctgggatattggcaaggtttcccttttgggcaaacattattaatttgtatttccggcggtatgctaggggtaattttcactgtgccgttgcgtaatgtcatggtagtgaaaagtgatttgccttaccctgaaggcgttgccgcagcagaagtattgaaagcgggtaatgatgaaatcggtggaagaggtgtcaaagaacttacaatcggtggtctgattgcagcggtagccgggtttttaactaatggtttacgtgtaattgcggatagtgcaagtctttggttcaaaggtggaaatgcaatttttcaagtgccgatgggtttctcactcgctctgttaggtgcggggtatttagtgggtatgattggcggtttagccattttattaggcatttttgttgcttggggagtagcagttccttactttacttctgtcgctcctatgccagctgatgccgatatgataggttatgctttcagtatttggaaaaataaagtgcgttttattggtgtagggactatcggtattgcggcaatttggactttattggtgttaatgaaaccaatgattcaaggtatgatcgagtcatttagagctttgaaagatccgaatgcaaaaaatactgaccgcacttcccaagacttatctccgacaacgctgattttcaccacgttagtaagcgttgtattaattgtattggctttatatagctttataaatcctgtgggtattgaagccggcacggcgatcattttaattttggtttgtactttacttgctgtcgttatcggtttcttagtagcagcagcgtgcggatatatggcaggtcttgtgggatcatcatcaagcccaatttccggaatcggtattatttctgtggtaacaacttcattagtgttaatgcttgttggttctgctacaggtttattagacacggcggaaggtcagaaatttttgaccgcacttacgctatttaccggttcaatcgtggtttgtattgcggcaatttctaatgataacttacaagatttaaaaaccggtcaattagttgaagcaacaccttggcgtcaacagtttgccttgattatcggtgtgattgtgggggcgttggttattgctcctgtattggaaattctttatcacgcctatggttttgccggtgcaatgcctcgtgaaactatggatccgagccaagcacttttcgcaccgcaagcaaccttaatgatgactatcgcaaacggtattttttctcataatctcgaatggaactatattttctttggtatcggctttggtgcggttttaattttcatcgacagcgtattgaaaaaggcgtctaacaaacgtttagcgttaccagcattggcagtaggaatggggatctacttaccgccgtcagtcaatgcaccaatcgttgtcggtgcattgcttgcttggttgattaatcgtcatttagaaaactttgcgaaacgtacaggcaaagatcttgctgatgtgaagaaaaaagcggaacgtttcggcacattatttgcagcgggtttgattgtgggtgaaagtttaatcgggatattactggcatttattgttgcaggttccgttacttccggaggttctgatgcaccgctagcattacatttagaaaactgggagagtctagctcaagtattaggcttaatgatgttcgctacgggtataacaatctttgcattacgtgtactcaaggcgaaacaataatattgcgaaaattaaataggacttgacaaaaaacctccagatttagaaagcggaggttttttctacacaattttgaaacaagaaaactaagtaatattcacttcataacaatacctaacgattaacgcacaccctgtttatctaatctggcgaaatctttacatccttgagcgttgccgttatcacatgcttgaccgtagaatgttttagctgtagaaacatttttttgtgcccctcgtcctttttcatacatatcgccgagatagagttgtgcttctgcaatgccttgttcagcggcttttgtgaaccaatagactgcttgttgatagttttgagcaacgccttgtccgtttgcatacatcacgccgagatagagttgtgcttctgcaatgccttgttcagcggcttttgtgaaccaatagactgcttgttgatagttttgagcaacgccttgtccgtttgcatacatcacgccgagatagagttgtgcttctgcaatgccttgttcagcggcttttgtccaccaatagacggcttgttgagagttttgcgtaacacctagtccgttcgtatacataaagccgagcatagattgtgcttttgcatctccctgttcagcggcttttgtgtaccaatagacggcttgttgagagttgtgtgtaataccctgtccaaacatatacattgtgccgagcacagcttgtgcttttgcatttcctttttcccccagttgtttgagtaagggaaaagcggcagaataattttgttgtttgtaaagttgagtagctcggtcaagtttttcgctattggtttcggcaagtgcagattgggcaacaccgaaagagagcaaggcgataagtagggatttttttaggttcattttatgttccttatttgacgattatttgaattcaatacacaaagtttgtggattgagaaaacattttcttcccgtttcaagaggggtgattggattcaaaatatttaaattagaatcaaataattgagagctgccattagcaatcattttattgacgatttcatccacctctttttgttcattaggattgatggcttttatattgtcgtaaacataaggcgaatctgaggtatctccaaaaaaattcttataaataccaacagtaatttcaatacgatttgacatggttttttcctctgatttgattttatatgtggcgttcgctacctactatcaagtaggtaggatgtagagtatactctacatcctttgacgtcctcccctagctaaagtaaggagattcctaccagctcccacagcaagctgtgggctactctcggagggtttctgctgctgaccgccaatgcgattcacttcacagacgctacgggcacgtcctgccctgattatgccgtcattgagagtctaaagcgacctctgttagcagtaagaagtatatcatatttgtgccttatatccatgccctaaaggacgtggttttatggcacgattagataaaggattgctaaaccctttgctcggtgtcgattggtctattgagtgttatttatacagcagtatattaaaaaacaactccggtttgaaaaccggagttttttatagatattaggcaaaagtatctaaatattgatctgttatttgggagacttatttgactagcccgccacttgcttgtaagtcagcatgatacgaagaacgcacaaaaggtccgcaagcggcatgctcaaatcccattttttcggctttatcacggaaatcatcaaattcctcaggtggaacgtatcgggcaacaggtaagtggtggcgacttggttgcaaatattgacctagagtcaacatggttacaccgttatcccgtaagtcctgcattacctgtaaaatttcttcattggtttctcccaagccaaccataatgcctgatttggtagggatatgtggaaaaatggttttaaattctttgagtaattttaacgaccaattatagtccgcacctggtctgatttcacgatataaacgaggtacattttctaaattatggttaaaaacatcagggggattatcttttaatttttctaatgcttgctcaatgcgtccacgaaaatcaggcaccaaaatttcaattttaatacctggattaagtttgcgaatttctttaacacattcagcaaaatgtcccgcaccacgatccggtaaatcatcacgatccactgatgtaataacgacataacgtaatttcatatcttgaatggtttccgccaatttttttggttcatccggatctgggggtaatggttttccatgggcaacatcgcagaatggacatcggcgtgtacaaattgcacctaaaatcataaatgttgctgtgccgtgattgaagcattcatgtaaatttggacaagacgcttcttcacatactgaatgtaatccatgacgacgcattccgtttttaatactgttaattttcgcagaatttgcaggaagcttgattttcatccattcaggtttttttaataactcctgatttggatcgatatttttaaccggaatgattgacgtttttgcagcatcacgatatttgacaccacgttccattttaaaaggggttgtcattaacagatcctaatttgttaataaattgttacatcattatagcccaataattgcgtaaagtgtgtaactaatttgggtgcaactttatcacattgagcttgttcagtgggtataaaatctgccatttggcacatttctaagcctatatagccacaaggattgatttgtctaaatggcgataaatccatgttgatatttaaggctaaaccatggaaagagcatcctttacgaatacgtaaaccaagagaacaaattttttgttcatttacatatacaccgggggcatcagctttcggataacttttaataccataatcagccagtgtgctaaccactgattgctcaagagcggtaactaattgacgaacattaagttcactgccgtttgctttgtgacgcttaatatcaatcagtacatacataatttgttgtcctaagccatgataggtaatttgccccccacgatcggattgtaccacaggaatatcggttggattgagcaaatgttcaggtttacctgcttgtccttgtgtaaaaacagccggatgttgaactaaccaaatttcatcagctgttagcacatttcgagtatcagtaaattctcgcatttgttgccacatttgttgataatcttggattccaagttggcgtataataagagtagtatctgtcattttctgtcttaaagtaccatgcgtacaccatcaattttggctagttcagtatagagaatttctacttgttcaatattttccgcaatgatatctacagaaattgaattataagttcctttgctactgatattttgacgagggttataatcacccttagcgtatttttgcgttaccataactacatcatcaattaaatctgctcggtttttaccaacgactttgaaagtaaaagagcaaggaaactccaacaaatcttttaattgtttttgtggaatgtcgttaagttttactgttttgtcagtcataaaatttccttaaagtgaaaatatgccgaaaagtgcggtctgatcttattgtttttagttaaacaaaccttttactgttaataccagccagtcccaaagtttgctgaaaaatccgccttcttgaacttcagacataatttttaagtttgcacttgcaatatcacgaccatctaattgataaataattttacctacaatttgtccttttgctaacggagctgttaacattttttgattaagctcgtatcttgttttaacatcattctggcgacctttaggtaaagttatataagcatcttccagcaccccaagttgcactttgtttgtattaccgtagtaaactttttcttctacaatagattggtttgcctgtaaagatttgaaggtttcaaagttagcaaagccccattgtaacaattttttactttcaatttcacgacctttgtgagtagcaacgcccataacaactgaaattaatcgcatattgttattatttactgcagaggcaaccaagttataacctgctttatttgtatgtcctgttttcataccgtctactttgattgatttatcccaaagtaaaccgttacggttatgttgcttaattttattgaaggtgaattctttttcagcatagattttatattcttcaggcaggtcatgaataatatgacgaccaataatcgccatatctctggcagatgaatattgattatcatcatccaatccatgaacggtcataaagtttgtattttttaaaccaaatttagcaacatatttattcattagttcaataaaattacgctctgaacctgctatatgttccgctattgccacacaggcatcattaccagatacaatcactatgccacgatttaaatcagctactgatacttgttggtttaaatttaaaaacattttagatgaaccgggaaaattttcccccaagcactttcatcaatggttacagtgtcggttaagctaattttaccttgtttgattgcatcgcctacaacataacttgtcatcatttttgttaatgaggcagggtgttgacgctgatccggattaaaggcggcaagaactgcacctgaatggtaatccatgagaatatagctttgtgcacttaattccggtgaagcaatgccatattgaatatcttgggaaagtgcaggtaatgaaattaatcctgacatcagtgcaatttttgtttttttcatcgctttttgtaacattttacatcctttaaaaattatttctcattgtaagagatggtgataaattaatgtaattggcggatttatttaacctatctttaaaaccttattgctaagatttaatgtttttacgtgttttagccaacgtttttgtacccggtccggaaatttttccataagcatcaacatataatgattctacctttacttttgctatgccagcatgaatcattccaagctcttttgcggcagcttcagataaatcaataattcgtcctttgctaaaaggtcctcggtcattgattcttacgatcactttacgattattgcgtaaattagttacgaccacataagagtttagtggcaaagttttatgtgctgctgtataggcattattattaaaaatttcaccgtttgcagttttacgtccatgaaattttttgtgataaaaacttgccattcctttttgtgaataattttttgccttctcgtagggtagtgttgtatatctaacgcctttgactacgtaagtatagggctttttactcagtttttgatagactagcttagctccttcaatgccatataattttttcgtatccgcctgtattgacagcgaaactaatgccataaaaagtgcggtgcataatttaaatattttgtttgacttcatagtaataagtttaatattgattgtgttatctaagataaatatttatttagttcctttgaaaaagttatttttatgtgtatgaatggacatgatcaaaccaaatccagccattaaggtaacaaaagaggttcctccatagctcattaaaggtaaaggtactccaactacaggtagaatgccacttaccataccaatattgacaaatacataaacaaagaaaattaatgtcaatgcaccacttaaaattcgtccaaaagaattttgtgcattaacaccgataattaaccctcttgcaacaataaagagatagatgagcattagtattgtaaatcctgtcataccatattcttcacttaatacagcaaaaataaagtctgtatgtggttccggtaggaattcaagttgcgattgtgtaccttgcatccaacctttaccccaaatcccccccgaaccgatggctatttttgattgcataatgtggtagccagcacctaaaggatctttttctgggtctaaaagagttaagactcttgtgcgttggtaatcatgcattaaatagagccatacaattggagtaaaagcagctaagcccacaatagcaattaagatgaaccaccagttgattccggctaaaaatacgacaaaaatcccggatgcactgactaaaattgacgttcctaaatctggctgaatagctactaataaagtcggcactattattaataataaagcaataaaaatttcacttaatttaggtggaagaggacgttttcctaaatatgttgcaaccattaatggtactgataatttaacaatttcagagggttggaaacgaaaaatccctagatctaaccaacgttgtgcccctttacttgttgttccaaaaagatccactaacagtagtaaaattacgccaatgacaaatccataaggtgcaatacgttgataaaaccttggtgaaaattgtgccatcacaaacataacagtaaaaccgagagcaacttgaataattcggttgcggaacattttttcactgcctcctaccgcactataaagtacaagcaatccataggaggaaatggttactaaccctagaaaaagccaaaaatcaatatgcaaacgacgccacaaaatcagccaaatattttttttctccatcaactttttcctttttcatttttcctttttcattttgtgattgtacttgtggcaaacggatatttaaataataatccataatttttcgaacaacaggtcctgccttagtgctaccaccaccggcattttccaaaataacaacaacaaccattttaggattgtcataaggtgcatatccgatgaaccaagcatgatcgtgcaatttattatcaagttcgtttgcattgtaagtttgattttctttcaggctgaaaacttgagccgttcctgattttcctgcaacaggataactgacatcaataaaagatttacgtcctgtaccattcggtgcgtgtattacattatacatgctttgttttatcgtttcccaaaataccgcttgaggttcagtaatatcttcgtaaagacgaggatcttgatagggttgcatttctgacccttcaattgctttcattaagtgcggagtattaaccttgccattattaactaaaactgcagttgctttggcaacttgtaatggggtggctgtccaataaccttgaccaattcctacagaaatagtatcaccctgaacccaaggtcgtttgtagcgtttttgtttccattcccgacttggcataagtgcggcggtttcttcttgaatatcaatacctgttggcacaccaaaaccaaagcgtttcatccactgagataaacggctaatgcccatgtcgtaagcaagttgataaaaataagtatctgaagattctactatagctttattcaaatcggtgtagccgtgccctgattttttccaatctctaaaacgtttggtggtattaggtaaaatccaatatcccgggtcaaatatcgtagtatttgtggtaattaaattttcttgcaggccagcgatagcaacgaaaggttttatcgttgaagccggtggataagcaccttgagtcacacggctatacaaagggcgattaggatctgtcagtaattgcttgtaatccgcacttgaaataccgccaacaaaaagattgttatcatagctcggggtagaaaccattgctaaaataccgctatctttaggatctaatactacaactgctgcacgaagattgcccaataaatttgcgatataacgttgtaattctaaatcaatcgttaagtgaatactttttccggcaatagcaggctgttcccttagtttgcgaataaccttacctctattattcacttcaacttcttcaaatcctactttgccatgtaagtcatcttcatagtaacgttcaataccgagcttgccaatatcatgagtgccggcgtagttggcgtatttttcatttttctttaaacgtgctacatctttttcattgattttagcgacataacctagaatatgagtcaacggctcaccatacaaatagtggcgtttaaagtaaggcctaatatcgaggctgggatagtgatattggtttactgcaaagcgtgcgatttgttcttcgctcaaatctcctttaaggagaattggcatatatcgggatgagcgacgacgttcctttttaaagttctcaatatcgtcatcatttaaaccaacgatatagcgtaactcttcaaaagtgcggtttaaatcctcaactttttccggcacaatatataagccgagaaaggtaatattttccgctaataatttgccgtagcggtcgtaaattagccctcgagtcggtggcaaaggaagtaatttaattcgatttccgttagatcttgtctggtaagtttcgtaattgacaatttgtaaataatacaaattggtaaataaaagtgctgataaacccaatacacctagaaaggcgataagagcacgacgagcaaaaaggtttctctccgcctttttatctcggatcggtgtttgtagaggttgagagagtaatttttttaaattcataaaatattaaccgcacttattctcggtgataaggatgatttgtgcttaacgaccaagcacggtataaactctcagccacaacgatacgtaccaatggatgaggtaaagttaaaggcgaaagagaccaactttgttctgtcgcagctttgcattcaggtgataatccttccggaccaccaattaagagtgcaacatttcgaccgtcatgtttccatgcttctaattgctgtgctaattgctcagttgtccaaggtttaccgggaatatctaaggtaataatacgacttttctgacaagcggataacatagctttaccttcttgttcgagaatacgtttaatatccgcattttttccacgttttcctgccgggatttctattagctcaaaaggcatatctttgggaaaacgacgttgatactcctcgaagccttttgtgacccaatcaggcattttagtgccaacggcaattaattgaattttcatagattaataagtgcggtcattatccccaaagtttttccagctgacacatttcacgactgtcagcttgcataatgtgtacaatggcttgaccaaaatctatcgcaatccaatctgcggtagatttgccctcttcgccaaaagtatcaatgccggcttgcttactctcatcaattaatttctgtgccaaagagattacgtggcgacttgacgttcctgtacataaaatcatgtgatcggtaatagaagatttacctctaacatcaagggctaaaatatctgtgccttttaaatcatctaatttactcactagaaaatcgactaagttcattttttctcttctcaattgcttatggttatttgcttaaaagtgtgtaatgttagcatgatttgggggagctaggaatatcgtttgatagtgtaattgtatacaaagaacgctcttttacttatataaaaaatttttctgtttataaatgatttctcggacagcgattggaagaaatgagcgtgtgtttattatttaggttcacaaaaatctcttatgtcagtaatgccacatacattgaaagcacatctgtattggttttcactaatgttctttatcaagaaactgcacctattaatggtacagttgtgttttgtcaaaaatacaaagtgataatatgtaattctaaatttttctaaatattaactacacgcatcgcgatatatttactataacctaaggcacataaaaaaaggcttgcttgaagtaagataatacaaggtcctgtggcgacgttgaaatgaaaactgagcaatacgccaaaaataccactgaatactgctgtgcaaacggcaattagcatcatataatcaaagcgtttagctaaaatatagcctgttatcccaggtgtaatgagcattgccaccactaaaataacgccaacaacttgcattgcactgatgatgactaacgctaggattaccagtaaaccatagtgtaaaaatttggtgttaagtcctgcaactcgtgtgtgacttggatcaaaacagtaaagcaacaagtctttgcgttttaaggcaatcaggataaatgccagtaatgcaatgccaatactttgccaaaattcttgcttaatgatacctagaatatttccgaacaaaatgtgcattagatgttgatcggtttccactttggaaaacagcaccaaaccgaaagcaaacattcctgaaaaaacaactcccatcactgtgtcttctttgattcggctgttatctctcaaataacctacggaaactgcacaaaagatgcctgcccaaaatgccccaatcgcaatcggaattgctaatacataggcaagaataattcccggcaatacagcgtgagaaatggcatcacccattagtgaccagcctttaagtactaaataacacgataaaatcgcacacactgccccaatgataggtgcgatgataatagcttgttgcataaatggatacaccaagggctcggtaaaccacgctacaatcgtattaaacatttggcttctcctgatttgcaagatttggtgaggaagtcactgctttttgtgtacttcgcttacgtggaataagaccatatttgggagcaaaaaagaaagcaagcaagaagatgaacgtttgcaatgatacaataaagccaccagttgcactgtctgcgaaataactcaaatatgctcctagtgagctagtagtaccaccgagtaaaatcgaaataatcaacaggcgatcgaagcgatcggtgagcaaatatgctgttgctccaggtgtaatcaccatcgcaattaccaaaatagccccaactccttgtaaggcggttacaatgcatgcacttaacaaggtaaagaataaaattttgaattttaaaggcgatagccctaccgctttggcttgaatttcatcaaagaacacaagcattaggtctttccaaaagagtagcaacaatacaaatgatataccgagaataatagcgacttggatcatatcttcatcggcaatacctaaaatattgcccaaaacgatagattgtacgttcacggaagtgggattaattgaaataatcaacaatccgagagcgaagaaagaggtgaaaataaaaccgattactgcatcctctttgagtttagtcacgtatttcactgctaaaatggcaatggtggcaagtagcccagagaaaaaagccccgacggcataaggtaatgccaaggcataggcaatagcaacgcctgggacaacggcgtgggataacgcatcaccgatcagtgaccaacctttcagcattaaataagcggaaagaaaagcacaaaccgctccaatggcaccactgaccacaatcgccttaaacataaaatcataagaaaacggttcaagtaatagctctaacatcgcattactccgcatcttgaataaaatgttgataacgtaaaacgccgccaaacacacgagctaaattttcttgagtaaaagtgctttcgattgatcctgcagcgagtagtgtacggttgatcatcaccgcttgatcgcaaaaacttggcacggtgctaagattatgcgttgaaacgagaacgagatgaccttcctgacgaagctgtttgagtaacgcaatgatggcattttctgtgccaacatctacaccagtgaaaggttcatctaataaaatgatttggctttcttgtgctaatgcacgagcaagaaatactcgttttttttgccctccagaaagctcgccgatttgtcgatctcgcaaatgagcaatattgactcgctccattgcgtctaaaacttttttcttgtcttgtgctttaggcatacgaaagaaattcatataaccataacgccccatcattacaacgtcataaacagaaacggggaactgccaatccacttcttcactttgcggtacataggcaattaagttttgttttaatgcccgattagcgggcatgttacaaatttcaattgaaccttgaggcttcactaagcccataatgcttttgaataaagtcgattttccacttccgttaataccgagcaatgcacaaatcgtaccaccttcaaggtggaaactcacatcgtgcaacgccgtatgaccattactataacgaaccgtaatatctctgacagaaagagaactgatgtgagttttcattcaattaccttattttttgaaaccattcacaatggtcgaaacagttacatttaataagtcgatgtaagttggtactttaccatcttttgtagaaagtgaatctacataaagtacaccaccgtattttgcattggtttctttagccacttgttttgctggcttatcagaaatggtgctttcgctgaacacaacagggattttgtgttcacgtacttttttgattacatttttgatttgttttggtgtgccttgttcttcagcattgataggccataaataaagctctttgaaaccgtagtcgtgagctaagtagctgaatgcaccttcactggttactaaccaacgttgtgaagctggtactttttctaactcagcacgtaatggtgcgtctaaagcaacgattttatctgcataggcttttgcattagcattgtaagtgtctgcatttttaggatcgtatttcactaaagcttcacgaatgttttcgatgtataccaaagcatttttggttgacatccaagcatgtggattcggcatacctttgtatggaccttcgtagatagaaattggatcaatccctttagttacaacaacagctggtttatctttcacttgggtaaagaaacgctcgaaccaacgctctaaattcattccattccaaagcaccaaatcagcagattgtgcttttacgatgtcttgtggagttggttcataatcatgaatttctgcacccggctcagtgatcgactcaacaacagcagcatcaccagcaacattctgagcgatatcttgaataacggtaaaagtagtaactactttaaattttgcgtaacttggtaaactgaatacagaacctaagattacacccataacaataagtaaacgtgacataatttctccttcgaattaatattagaaacaaatttgcatttcaagcgaactcggtcttgcatagtactgcaaaaataacttattgtaaatagcaataattatcaattaaagacattttattggtttgggtaaaccagctaattttgaagcttgttttgcgggaccttctgggaataaacgttgtatgtaacgactattgcctttatctgcacctagcttttgtcccaatgctttgactaacattctcattgctggtgaggttttatactcttgataaaaatcccttacaaagttaataatttcccagtgggcttcggttaattcgatattttctgattttgcaatggctatagcgacatctttattccactgattcatatctaatagatagccctcaacatcagtttcaatttgaacttggttaacacttaacatatgttactatttttgtccttttgatatataaaaagtaaaaagcccctattcaaggggcataaaacaagtttaatcaattattcatcacggttgaaaatacctagtaaattgagcaagctgacaaaaagattgtaaagtgaaacatacaaactaaccgtagctctaatataattagtttctcccccatgaatgatattgctggtttcatataaaatagccatagttgagaaaacgataaataacgaactaaatacgatgtgaaagccactcatattaaagaagaaacttgctatcatgcctataaccagtacgataaagagagcaagcatcatgccggataagaatgacatatcttttttcgttgttagcacataggccgagcatgtaaaaaatacacttgcagttccggctagagcaagaacaaccaaatcacctaatcctgagccaacataatagcttaaaataggacctaaagaatagcctaataatcctgttaatgcgaatgtagataaaagtccccaagcactgtttgctaacatattattgaggaataataatccataaaaacctaccaacatgacaccgaaatgaagtggagggagatttaattgcattgcactgaaggcgacaacagcagaaaaagccaatgtcaatgctaataaaaagtaggtgttacgtaaaaccttatttgttgccagtaccgattcttctttagtatcaacaataaaacgagattgcataaaagctcctaggttgtagttgtaaataaaaagtgaaaagctatttataagttaatggttagcaactttaatgtcaacatgaatatttttcagaaaagagtaacattgaagtaaaattaaataaaaatggataaattatcaactcttaaaccataactgttatttttttagtttacttctatttctatctatattatattacgcctcgtcaagacggaggaatggtcgagtggttgaaggcaccggtcttgaaaaccggcgagggtttacgccctccgtgagttcgaatctcacttcctccgccatcaagttttactaagtcgtaagttatgcctctgaaatcagtaacttacggcttttttatatcaggttaattgtcgtaataacttgcttaaaaatcaccgcacttattggtctgatagtttccgtagcaaacgatccatggctcgatagcttaatgcttcagctaagtggttttgtttgatatcagaatctccgtttaaatcggcgatagtgcgtgcaacttttaaaattcgatgataagcacgaacagataaaccgagtttggttaaagtattttctaaaaatagtgcatcttgctcagtcaacttgcaatctcgctcaatttctttaccggttaaataagcattgacttttccggctctagctagctgaatttctctgacccttaatactttttctttaacttgtgctgttgtttcacctcgatcttcggtattttgcaaagcaccttgtggaagtaaaggcacttcaatggaaagatcaaagcgatctaaaaaaggaccggaaagtctgttcaaataacgcaacacttgttgtggtgaagtgcggttgtgtataccagtataatgtcccgttggacttggattcatcgctgccactaattgaaaacgtgccggaaactgaatttttgcattcgcacgtgaaataattatttctccgctttctaaaggctggcgtaaagcatccagcactctccgttcaaattcgggtaattcgtctaaaaataatacaccgttatgagccaaagaaatttctcccggtttcggaattgttcctcctccaaccaatgccggtgatgaggcactatgatgaggtgcacgaaaaggacgttgtttccaattttgaaaatttaattcgttttgtaccaaacttgttacagaggcggtttctattgcctcttgatctgtcatatccggtagcaagccagttagacggcttgctaacatggttttacctgtgccgggcggtccgagaaacaacaaattatgttgtccggcagctgcaatcattaaggctcgtttagcatgttgttgaccaataatatccgtcagatctttattagattgaggtgaaaaatctaccgcactttgcatacataacgttgtggatgaaggtagcgaactgtcgtcattcaggaattgtacgacctccaataagttccgtgcaaaaaatgtttcgtgttgtgaaactaaagaggcttcattagcattttgttgtgcgacaataagttgacgcttagatttttgccccgctaaaatagcagggattacaccgtgtacgcctcttaactcacctgtgagagccaactctgcaacaaattcaaattgttgtaacttttttgcattaatctgttccgaggccgctaagatgccgagtgcaataggtaaatcaaaacgccctccctcttttggcaaatctgccggagcaagattaactgtaatgcgttttgccgggtatttaaattgagcattgagtaatgcactacgtactcgtccttgagcctcagttactgttttctctggcaatccaacgagggtaaaagcaggttttccattactcaagtgaacttcaattgtcaccaaaggtgcttgtacgcccattgatgctcgactgtaaacaactgctaatgacataatttctcccaaatttttgagctaaaatataaaaaaagcagcgagtaaactgtacttactcactgcttttttgcgatccggatcgtaaaagtaaaaaagttttagctaaaaagcggagaaaaccattgatctaattttgccgataaacgttcgataccgattttattttgtgcggaaaaggcttcaacctgtacatcaccttggaaaggtaaaatcgcttctcgaaccatttttacttgcttacttctcgcactttgactcaatttatccgcttttgtgagcaacaataaaaccggtaaatctgcggagaccgcccattcaatcatctgttgatcaagatcttttagaggatgacgaatgtccattaaaataaccaaaccacctaaacattcccttttttgcagatactcacctaaagatttttgccactgaagtttcattttttcgggaacagcggcatagccatatcccggcagatctaccagcttacaattgggttctacttgaaataaattgattaactgagtacgtcccggtgtttttgaagttcttgctaaatttttttgctgggtcaacgcattaagtgcggtagattttcctgcattagatcgtcctgcaaaggcaatctcaatcccactatcctcaggtaataccttaatattaggggcactcattaaaaaatgggttttatgataattcaattttatatctgtcattttattttttcttcggtcgttgccagttggaaatatggcgttgtggaacacgagtaataactaactcattttcttgtacatctttagtaacggttgctcctgcaccaatagtcgcaccgcttgcaatggtgagaggtgcaactaattgactatcggaaccgacaaacacattatcgccaatcaatgttttaaatttattggctccatcataattacaagtaatcacaccggcaccgatattacaatgatgtccaatttcagcatcgccaatataagtgagatgatttactttagatcctttgccgatttgtgcttttttaatctcaacgaagttacccacatgagtatcttcattcaattttgcacccggacgtaatcttgagaatggtccaattttggcattattacccacaatggcatcttcaatcacagaataaggttttatttccacattatctgcaatcgtacaatttttcagtacacaacctgccccaataaacacattattgcctaatcgtaccgttccttcgataactacatttatatcaatttctacatctttaccatgagttaattcaccacgcaaatcaaaacgtgcaggatcagcgaaagtaacacctgcaagtaacaatttttctacttgcttacgttgataatgacgttctaaattagctaattgtaaacggttatttactccctctacttccataagatctttagcttgtaccgctacaactttgaagccatcttgattggcaagttctattacatctgtcatgtaatattcaccttgtgcattattattatctaaacgagctagccatttacggaaacttgcaccgtccgataccataacgcctgtattcacttccgtaatttttagctgctcaggattagcgtctttctgttcaacaattgccgttactgtaccgttttctcgaatcactcgcccataacctgtaggattgtctaaattaacggtcaaaagtgcgataccattttccggtttttgtgaaattaaacactcaagggtttccttgctaattaaaggtacatcaccatataacatcacaatattttcgtcatcttggaaaaaaggcactgcttgttgcattgcatgccctgtacctaattgttcagattggaatacccagtttacaggttcatcagccaaatgttgttttagtagatcagcaccatgtccataaattaaatgaatttgtgccgcacttaattttttggcggtatcaatcacatgtttaaccatcggtttacctgcaattttgtgcaatactttaggtaaatccgaatacatgcgagttcctttaccggcggcaagaataacaacgcttaatttgttcatgataaattttctctttgtcataataatcgatgtattttagcgtaaaacacatgaaaaaataatataatgttattatgtttagcaaacatacgttcttcttttatgcaaaaaaataatcactattatattggaattatgtccggtacaagtttagacggtgttgatatagccttaatggattttaatcaaagaccgcccaagctacttgcaagccattgtttctctatgccggaaaatttacgccaacaactcaccgcacttttaaaaaacggagaaattggcttacagcaattaggcgagttggatcatcaactgggattactttacgcaaactcggtacaacgtttcttagcacaaaatcaaatgaccgctgatagtattcaagccatcggttgtcatggacaaacgatttggcattcaccccaaggtcaatatcctttcactatgcaaattggcgatgctaacctgattagtgtactgacaggaattacgactatcgctgattttcgtcgcaaagatatggctcatggtggacaaggtgcacctttgtcccctgcatttcatcaagccttatttgcacaacccgatcgcattacggtagtgttaaatattggcggtatcagtaatatttcttgtttaattccggaacaagaagttattggttatgataccggtgtaggtaatgctttgatggatagttggattgaacaacatttaggggtgcctttcgaccaagacggtgaatgggcaaagagcggtagtgttcaccaagatttgctaaaagatttattggacgaacctttttttcaacaacttccccctaaaagtactggacgggaattatttaatttggcgtggttgaacaaaaaactgaaaaaacataccgcactttctgcacaagatgtacaggcaacgttgctggaatttacggtacaatgcacggtgcaagagctggttaaactcactaatccgaaccatttgccttgtttgttgttggtttgtggcggtggtgcaaaaaacagacaactaatggctcgtttacaagcctgtttaccgcaatggcacgtagcaacaactacagagcatggtttatcggttgattatgttgaagccgccgcttttgcttggttagcgtatcagcgtataaatcatttaccctctaatttaccaagtgtaaccggtgctaaaagtgcggtcagtcttggcgttatttatccgaaataatcatgaataaacaaaatttaattaatcagttcgctcaactaattaccgagcaacccaatccactctcagtaaatttggatcaaatgtctgcacttgaaattgtacaattgatgaataaagaagatcagcaagttccactcgtcatagcaaaagcacttccggaaattgccgttgtagtggaaaaaatcgttgctgcttttcgtcaaggtggacgcttagtgtatcttggagcggggacaagtgggcgtttaggcgttttagatgcctctgaatgtcccccaacctttggtgttaatcatgaaatggtaaaaggcattattgccggaggagaacaggctatccgttatcctgtggaaggcgctgaggataatcaacaagcggcaatagtagatctgcaagcaatccaattatgttcaaaagatattttagtgggtattgctgcgagcggtcgtacaccttatgtcatcagtggattaaaatatgctaaaaagatagggggatttaccgttgcaatagcgagtaatccgcaaagtgctatggcaaaaattgccgatattggcattgaaactattgtcggacctgagattttaaccggttcaagtcgcctgaaatccggtacggcacaaaaattggtgctgaatatgctaaccactgcaagtatggttttacttgggaaatgttatcaaaactttatggttgatgtacaagcaagcaatgaaaaactcgttgatcgagcgacaagaattattatgcaagcaaccggttgtgaacgagcgaaagcagagcaaacgctaacacaagcagataataatgcaaaactggctatcttaatgattttaatggatttagataagcaaagtgcggtggatttattagcgaaaaatcaagataaattacgccaaacgttagactgatttttcaccactacttttctactaaaaaggctgtcagtgcatttgagagatgagatagtttgtaaaaaataggcggagaagataaaataaagtggttcgaaactgtagattaaatctaactagttaatattgttcataaatattaatattcaatttataaacaaacattcggacatgaattgcaagctggatatgtatagtttgcaactgaaatatgatctcaaggaggttaaatgtctttattaaatatcattaaatcgtttttctcatctaaaaaggagcaagccatgccgaatattctcgtcatttcaggtcattcaaatttacagcaatccactgccaacagtgctattttaggtgaattggcaaataaccttccaaatgcagaaattcgtaaattagatgagctttatcccgatttcaatatcaacatcgaagctgaacaagcggcattattaaaagccgatattatcatttggcaatttccggtgaactggtaccatttcccagcgattatgcaaaaatggttatctgatgtgttcacttatggttttgcttatggttctgagcaaaaattaactggtaaaaaattgtatatttcttgtactacagcaagtccagaagaagcctatcaacacgatggtgcacaaaaacataccattgaagaatttagttatgcttatcagcaaactgccgcactttgtggtttagaattttgcggtattattcattctggcaatatgctttatattccgggtatgaatacagaggaagataaagaaaatgtaattgcaaaagcaaaacaacatgctgaacgtctagtaagtgcggttaaataacacatcatgttaatagacaaaagggacataatgttttatgtcccttccttgagtcaaaataacgataacatttcatcatcatatctttttttaaatctcaattttttctgtatttttttgaaaatctatatcgtataatactcagtcggtttaacgataacattaaactatgtaaacattacaaacattattttttctaaataaggggtctcttatgagatacaaattatctttagtacttttatcaatgctgcccgcactttcccatgcgggggggggggggtaatttcaacttttacggcaaagcgggaattgatttaacctctcgttttgaaacgatgaaaataacacaaaattacgatagtgctggcggttttaaattatcaattccggcaagttcaagacaaaacactttctcacccagtatcttctttgaaacgacttacaatatttttccgcaaacggaaattggtctcggactaggctatatcaaacgaaaaggctttgaccatattgcaatttggcccgtcgagggtagtgctgaatacgatccgagcggacagtttcatctgaaagaaacctatagagtaaatcgttatgcttccctaccaatttattttattttgaaacaaaattatgccttaaatgcaaatacaaaattttatctaaaaggcgatttagggtattcaattaataaaattcgtaaaacggtgtatactctctatggagatttatccttgggtagtatatgaggttataaaaaagacagagattttgttagtaataataaagcaaagagcggtctgtatttaggcttaggtattgggattgaatataaatctttcttagtagatattggatattatcatacccattcgaaaatcacttataaagaacaagaaagttacgtatcaacaccctataacaacgatgcaatacgcttaacgcttggctttaaattctaaaaaataaaaaattaacggtcataaaataaatgttttatgaccgttaaacatattcgttaataatgtaatgctaaaaaaacatcaattattttctttaagtctaaattgttgattgcggtgttgcacaaatgagtagatgaaatacaatactgtcgctgcaccgaaacagtaataaccgatccacactgccggcaacacgtcttttgccatgaaaatatacagagaaattgaaataaatgtgatgactaaagaaacagcttttgcataagcccaaggttgaatatccacttgcttagtgtattcttcgttgtatggtgtttccattggcatgatgcgaccgataattagcattactactacattcacaacaaataagatagcgattaagtggaaaaaatggatctcaactttaatcacaaatttacataggatataagctaccataccaaatactaaaccgaatttagccgcaatcgctgggacacgttttgtcagtaaaccaaccaccacaacactcaaaattggggcattaaaaataccttgtaattcttggattaagaagaataaaccatccggtgcattggcaactaatggtgcaacaatcattgccatgattgctaaacctgtaccgacccatttgcccacgctaactaatttcatatcgcttgcatgaggattaatttgtgttttatatacattgcgggaaaataaagttaccgatgagtttaaggcactattaaaggtggataaaactgccccaacaacaactgccgcaaagaagccgactaacgcatctggtaagactaaatgaactaaattaggataagcctgatctggaatatctaatttaccttggtaaatatgataagcaatgataccgggtaaaatgattaataaaggtcccagtagttttaaaaatgcacataaaagaacacctttttgtccctcttttaaacttttcgcacctaacgcacgctgaataatggattggtttgtacaccaaaagaataaattagaaataatcattcctgtgaataatgttgagaaaggaacaacagaattatcgtcaccaatagaattaaatttatcagggtttgtttcgtaaatggtttttaaaccatgccaagcattaccatctcccacataagctaaacctaaaacagccactaaaattccaccgaccaataacccgataccattaatagtatcagatacagcaaccgctttgagtccaccgaaaattgcatagactgatccgagtattccgattccccataccataatccaaattgccgtagtcttatcaatgttgaagacggtagagacatcaaagagactttctaatgcaagtgcacctgtataaagcacgatcggcaacaatgaaataacatagcaaccgaggaacaataaagaggtgattaacaatgttcctttgtcaaaacgtttttctaaaaattccggaatagttgcaatgccaagttttaaatacttaggtaagaagtaaagtgcaaacattgcaattgtaattgccgctaaaacttcccatgccattacgataaaaccttcacgataagccaaaccgtttagacccactaaatgctcggtagaaaggttagttaataacatagatcctgcaataaacgttgctgtcaacgaccgcccggctaaatagtagccttcagagttgctaagatcgtcttttctggtgtaccaccaagcaagcacagcaacaagggctgtaaatcctataaatgagataagagatagcatagaaattccttatatgaatgagtgtttctatcattgttgtaaacaacacatcgataaggtcgaaaggtgaccttgtttgaaatatatatttcaaaaattattaaatcaaatattttttttcattttgttacagagatcaaactttttagtgaaaaactatcagaaagtaaccaagaaaattttatttttaagacttgtaaactcaatatgacattttggtctatatctcaagaaacaaaaatttaaattaaaaacaccgcactttttacattgcataacaccgttactaacaggtaaactagacaaggttaaactagggatgaatatgaaattactaagtaaatattttgtcagatcaatactgaacacgagcatattttgcatatacctagcaagttcgttttcttttgctgaacatcttgttgatttaaaagttgttggtgtaactggtgtacaaaaaacgactaatgtagacgcttatataaataccattgatgaagaagagcgtgatggatctgaacgttatcgacaattagttcgaaccgcaattgataaagcattacgtgcttatggttattacagtagcacagtgaatttcactttacagccggcgaaatcatctaataaacccgtgcttgttgcaaatgtggacatgggaaggccaagtattattcaacgtgccgatgttactattcttggtgaagcaaaagatgatgaggtttttcaagatttacttcgtcgtactgcccaaaaaggcgaacacgtaagccatcctgtttatgaggactataaaagccggttgcaaaagcaattactcgctcgtgggtattttgatgcaaagtttgaggtttctcgttttgaaatcaaaccatccacttatcaaggttggtggaaaatggttttaaacagtggcactagatacaaattcggacaattcaattttaagcatagtcaaattcgtgaagattacttacgcaatatgatgccaatcaaaacaggcgataaatatttaattaatgatctctcatcacttaccaacgactatacatcatcaaattggtttagatcggttttattagaaccgaaagtcgatgaaaaacgcaaggtggttgatattaatgtattgctttatcctcgcaagaaaaatgcaatagatgtagggattgggtattcgtctgatgtaggcactcgattcaagctcagttggattaagccttggattaataatcgtggacatagtttcaattccaatttatatatatcagccccaaaacaaactcttgaggcgaattataaaattcccttactgaaaaatccgcaaagatattattatgaactgtctggtggttttgaaaaggaaaatactaaagatactcaaactatagcagcaagttttgctgcattacgctactggaatagagtgaccggttggcaacattcttttgggttacgtgtacgttatgactcatttacccaagccaatgtttcagatagaacattatttatttatccaacaatatcggcgaatagaacacgcttaagaggtgagttatttcctacttggggagactcacaacgcatcacggtagattttggaagcaaacgttggaagtctgatgtaaacttctttcgaataaaggcctcaacagtttggatcagaacgtttaaagaaaatcatcgtttcttgacacgtggcgaaataggttggttacacaccaaagatattaataaaataccgcccgcacttcgcttttttgcaggcggggaacgtagtgtgcgtggatacggttacaagaaaatttctccaacatcttctgatggcaaaccaataggtgcaccatatctattaactgttaatactgagtaccaatatcaagtacttgaagattggtggctggcagcctttgctgatacggggttggctgctaataaatttaacgttaaagaactacgttatggtgccggttttggtgtgcgttgggtatcaccggtgggagcaataaaacttgatatagctacaccgattcgagatagagagaagaataaaaatatccaattttatattggattaggttcagaattataaggtcgtaaaaatgacacaaataccaaatgaaaatacaacaacagagcgacaggaaactcgctcggttaagccaaaacgtaaggtattacgctggattttatgcacaataagtgcggtcgttttattacttattttatttttagtaaccgcactggctacaaatagcggacaacgcttgttcattcagcttgctgatcatttcatagataatctgcatattgctcaaattgatggtgggttgcaagacggtttacaattaaaacaaattgcttttcacactcaaggtattaaagctgatattgaacaagcaaatataaaactggacttacattgtctattaagtggcaagatttgctcaaaagatctcactttaaatcagcctaaaattcagattgatactgctcaactgccaaagtcggaaactaaaacgtcacaaccaatacaacaaatcaagctacctgttgaagtggacatcaatggtattgagatcaaccagctggatctcacaatagaccaacagcaagttaaattagcaaaatttcggaccgcacttactttaaacaatgagcaaggtttaactttactgcccacagaaattaatggtttaacgatagttcaccgacatctcacagaaaaaacaacgaagaagaaaaagagtgaaaaaactgtaagatcctctgttgattgggaaaaacttacacaacagttaaatcaaccgttattgcctgatatgcccgaaattgagctaccttttgatctacatattcaaggtattcaaggaaaaaattggctatatcaacaaattggcaattcaaatataccgcaaagtgatttacaccaaattgaaatatcaactatttatttacacgcagacagtatagataattctattcaattacaaacgtttcaacttgaaagtaatttaggtcagctacgaggtgaggggacattgcaactcaagcaagaatttccgatagaactacaagttcaagcaacgctcaatgaacttaaacatgatggaaaattgcttttgcctcacagtaacatcaatcttacattaagtggaaatcttaaaaaacaaacctcacttttcctgcaaactcagggaacgtttgagtcgatattacagggtaaaattgagctttattcacaaaaaacaccgtttgacattgaattaaaagtaataaacggacaatatccctttgagaaaaactctacagaaccattgaaaattcaggacatgttttttactgcaaaaggagatttgctcaattatcaagccacattacaaggcaagctcattggtatgggaatgcctgaaaccgatgtggatttagcactacaaggcggattgacacaatttaccttacaacaacttcaagttaatgcgttaaatatgaaggcgaatgcaaacgccaatgtgagctggagagataaacttaagttgaaaagcaatattgatctaaaaggacataatgttcggctaaataatatgcgaattaacaaaattgatttattggctaacattagtttacaagatatagtgcaaggacaagtcgatcttgatattgatggtttcagtttaaataatattaaattgaacagcactaaattacaaattaagggaacggaacaacaacactatttaatccttaaatcaaaaggcgagccggcttccgccaccttaaatttacaggggaaatttgaccgcactttacaacaatggcaaggtattttaagtcaagtgaatattcattctttaattggcaatttgaccaatagtgaaaatattttgttgtcttatgataataaaaagacaattgcacaagtttctgcccattgctggagatcatcggatattcatctctgttttccacaagagttcattgtaggaaaaaccggagaaattccgtttgattttaaaacaattaatttagcgttagtgaataaattgatctcacaagagattttcaaaggacatttatccggtcaaggaaaattcgcatggtttacggagagttctccttatttgacgctacaacttaaaggcgataatctcaatgtggcaaaaaaattagattatcgtacttttcgtttagctatcccaactttaaatataactacagagttacaaaacaataacttaaccctaaattctaattttaatattcaaaaccgaggagacgttaatatggaattaaaattagctgatttaaccaatcagaaaaggttaagtggtcatttaaaaattagcgatatgaatttaaatatagttaatcagttaatcgctagcagtgagaaagtagatggtcaagtcaatgcaaagttgagttttgcaggtgatttaagtaatcctcttttgaatggtgaatttgctgtgagtcaagttcgagctaagttgaaatcagttccttttggtataacaaatggaaatattacactgagcttttatggtgatcgttcaattctaaaaggaaatattcaaactcacgaaagtcatttaaatgttgaaggtcaagcaaattggcgtaatatcgacgattggcaagcaggtttacatattaatgcagataaatttaaggtagatattccttccatagctaaattacaggtatcgccaaatattgaaattcatgcaacacctaaactattagcgttaagtggtaatgttgatattccatgggcaaggatcgaaattgaacgtttacctgacaatatagttgctcccagtaaggatgaagtgattttagatggtccccaaaaaactaaagtagttaaattgatgaaaggagaaattgagacaactacaaagagtggtatacaaattcactctgacttaaaaatcaagctcggcgatcatgtgcgtttagaggcatatggtctgaaaaccgaattaaatggcttgctttcagtaaaacaagaaaaaggcaaccttggcttatttggacaaattaatttacacaatggtcattatgaatcttttggacaagatcttttaattcgtaaagggattattagcttttccggtttaccttctcaacctatgttaaatatagaagcaatacgaaatccgacatcaatggaaaatacgaatatgacagtaggtgcaaaaatagttggtattgccgatagtcctgaaatcactatattttccgagccaagtacctctcaagatcaagcactctcttaccttcttaccggacgatctttagaaaatagcggaaataatggttccggtggctcacttggtgctgcattattaggaatagggttagctaagagtggaaaattagtcggtggtattggtaaagtatttggtattcaaaatttgaacttggatacttctggtgttggcgacagttcaaaagttgtcgtaagcggtaatattacccctacattacagataaaatatggtattggtttattcgatggattggctgaattgaccctacgttatcgcctattacctaaactttatttacaatccgtttccggtataaaccaagcagtcgatctactttatcaatttgaattttaacgatgaataacgaaaatttattacaaaaagtaaccgcacttgtacaacaccgcggtgaagcgaaagaaattgccgctattgatttaggctccaatagctttcatatggtgattgcccgaattattaacggctctattcaagttttatctcgtttaaaacaaaaagtacaattggcggaagggttagatgaaaataatatgttaagccaagccgctatcaccagaggcgtaaactgtcttgctctttttgccgaacgcttacaaggatttgatcctcaaaatatcaatgtagtcggtacttatacattgcgaagtgcggtcaataagatagaatttttacaacaggcggcagaggttttcccctatccgattaatatcattagtggggaaactgaggcaaaaacgatttattccggtgtttctcatacccaacctgagatcggtcggaaattcgtgattgatattggcggcggttcaacggaaatgattattggcgatgattttatccctttaattgccaatagtcgcaatatgggatgtgtcagttttgccaagaaattttttccatgtggcaaaatatcaagggataactttcaacgagctaaaaaaacggcaaaacaatgtattgaagatcttgccaaaccttatcttgacttaaattgggattgtgttttaggttcttccggtaccatcaaaaccgttcatcaagttattagtaccaactataatcaacatgcaattatcacattatcgcacttaaacaagttgataacacaagtattgaaagctcaccatttcaataaattacatatcaatggacttaatgaagatcgtgtagatgtatttgttcccggacttgctattttgaccgcactttttgaaacctttgctatcaaagaaatgcgttattcagacggagcattgcgtgaggggattatttatagcttggaaaaggatttccaagtcaaaaatattcgccaacgtaccgcacttggtattatgcaacaatttaatgtggatctcgcacaagcggagcgaacctatcaaagcaccttattgctcagtgaacaatatcaacgttggcaagctgttgaattaaaaactgaaatgcaagatattctgttatgggcggcaaggttacatgaagtgggggtcgtgattaaccataaaaatttacaaaaacattccgcttacattctacaaaatatggaattgcccggctttgataaagaacagcaacgcttacttactacaataatccatcaccaatttaatcatttcaaaatgcttgacattggaaaatttgcacgctatccgagggctgatgtaatcgcacttgttcgtttattacgtttggctattttactcaataaatctcgccaagcgacatcgaaaacaaataacattaccctaaaaatcgaccgcactctaaaaaaatggtcattatattttgatgcagaatatcttgagcataaccctttagtcaaaaatgaattgatggaagaacagaaacgcttgtcagaatttaacttagcactggacttttattcttaaaaaacgttatatagtagaacgtgcttgtttcatatcagttattgagtactacgacaagatagactaatcaagcaatgaagacgggcagttttaacatgattagcgatgtgtttaagaatgcaagaaacagtgataaaaatttaaaaataatattattttacttggagagattatgcctaaactacgttcagcgaccagtacacaaggtcgcaatatggcaggtgcacgcgctttatggcgagcaacaggaataaaagaacatgatttcggaaaaccgattattgcggttgtcaattcatttactcaatttgtacccggacatgttcacttaaaagatatggggcaactagttgctactgaaattgaaaaatttggtggggtagcaaaagagtttaatactattgccgttgacgatgggatagcgatgggacatggaggtatgctctattctttaccgagccgagatttgattgctgatagtgttgaatatatggtcaatgctcactgtgccgatgcgatggtgtgtatttctaactgcgacaagatcacaccgggaatgctaatggcagcattgcgtttgaatattccgacggtattcgtttcaggtggtccaatggaagcgggtaaaaccaaattatccgatcaaatcattaaattagacttagtggatgctatgattcaaggtgcaaatccgaatgtttcagatgatgtcagcgaacaaattgagcgttctgcttgtccaacttgtggctcttgttcaggtatgtttaccgccaattcaatgaattgtttaaccgaagcactgggcttgagcttaccgggaaatggctcatgtttggctactcatgccgaccgcaaacaacttttcttagcggcaggaaaacagattgttgaactgtgcaaacgttattatgaacaagatgatacatctgttttacctcgctcaattgccacaaaagaagcctttgataacgctatgagtcttgatatcgctatgggtggttcgaccaataccgttttgcatttattagctgctgcacaggaagcggaagtcaatttcactatggcggatattgatcgcctttctcgggtagtaccgtgcctgagcaaagttgcaccaaatacccaaaagtatcacatggaagatgtgcatcgtgctggcggtattatggcaattttaggtgaattagatcgtgccggcttgttgaatagccaaactcgtacaattttgggtatgagcataggtgaacaaattgcaaaatatgacatcaaactcactcaagataaagccatacataaatttttccgtgcaggaccagcagggattcgcactactcaagctttctcgcaagattgtcgttgggatacggttgatgatgatcgtgaaaatggttgtattcgcagtaaagaatttgcgtacagccaagatggtgggttagctatgttgtcaggcaatattgctttagacggttgtatagtcaaaactgctggagtagatgaaagcattttaaagttcagcggtaaagccattgtatttgaaagtcaagaagatgctgtatcaggcattttggggggtaaagtacaagctggacatgttgtggtgattcggtatgaaggaccaaaaggcggaccgggtatgcaagaaatgctttatccaaccagttatctcaaatctatgggcttaggtaaagcttgtgccttacttacagatggtcgtttctccggtggtacatcgggactgtctatcggacactgctcaccggaggcggcggcaggcggtttaattggtgtagtaaaagatggtgatattattgagattgatattccaaatcgtcgcatcgaattgatggtatccgaagaagaacttgctgagcgtcgagcagagcaagataaacttggctggaaaccagctaatcgccagagagaagtttcctttgctctaaaagtttacggatatttcgcaacatctgcggacaagggtgcagtacgagataaaacgaagatataaaagttaaaagtgcggtgttttttatctaatcgtgccctaaaaccacgtcctttagggggggatataaagcacaaatatgatatacttcttactgctaacagaggtcgctttagactctcaatgacggcataatcagggcaggacgtgcccgtagcgtctgtgaagtgaatcgcattggcggtcagcagcagaaacccaccgagagtagcccattgcttgcaatgggagctggtaggaatctccttgctttagctaggggaggacgtcaaagcagaaatggtagtgaaaatggcactttctgtaatagaaaaagttagtgatgattaataaaaataatcaaaaccaacttttgtctactgtgcttttttagatagcaggataaaatcacacctttttattaactattgaacttcaatactggcactttattttcggtgactgtttcttcttccactataactttctgtaagttttcaatagaagggagatcatacatagtatcaagcaatagggtttcaacaatagatcgcaaacctctggcacctgttttacgagctagtgcttttttcgccattgcaatcaatgcttcttgggtaaattctaattcaatattttctaagctgaataaaacttgatattgcttagttagggcatttttcggctcagttaaaatttttaccaaagcctcctcatccagttcgcttaaaggtgcgataacaggtaaacgaccgataaactccggtattaagccaaatttcattaaatcatcaggttcaacttgcttaaataattcggttaaactgactttctcttcatcaatacgaacatcagcaccaaaaccaatacctttgccaccggtattcgttcttttctcaataattttatctaaaccggcaaaagcaccgccacaaataaataaaatcttagaggtgtccacacgcaacatttcttgttgaggatgctttcgtccgccttgtggaggaatagaagctaccgttccttcaactaattttagtaaagcctgctgcacaccttcgcctgatacatcacgagtaatagaaggattttcagacttacgtgtaatcttatcaatttcatcaatatagataataccttgttgagctttctctatatcataatcacaattttgtaataatttttgcaagacattttcaacatcttcaccaacatatcccgcttcagttaaagttgttgcatctgccattgcaaagggaacattgagcatacgagctaacgtttgtgccaataaagtcttgccactgcctgtcgggccgataagcaaaatattacttttgcccaattcaacctcagaagtatttttttcgctacgtaaacgtttataatgattatacaccgccacagctaatacttttttagcataatcttggcctatgacataatcatctaaatgtgcacgaatttcatgtggtgtcggtaatttaggctcttcctcttgaaattcttcatcaatttcttcgatgtcatccgcattagctaacatgtcatgacataattcaatacactcattacaaatataaccggatgtgcctgcaattaatttatctacttctttttgttccttaccacaaaaagagcaatgtaattctttttcttttgtcatttctttacccaatatctaccgtttaattaacacgtcatcaactaaaccgtacaattttgcctgttctgcagacataaaattatcacgatcagtatcttgttcaatttgttcaatagattgtcctgtatgaaatgctaaacgttcatttaacgtctgcttaatttttaaaatttcttgtgcatgaatttgaatatcagaggcttgtcctctaaagccacctaaaggctgatgaatcatcactcttgcatgaggcaatgccgcccttttacctgctgtgccacccgccaataaaaatgctcccattgaacatgcttgtccaatacaaagagttctcacattaggcttaataaattgcatagtatcataaattgccattccggcagtgactgaaccgccgggagagtttatataaatattaatgtcttttgctggatcttccgcttccaaaaagagaagttgagcaacaatcaagtttgccatacgatcttcaacttctccagtcagaaaaatcacccgctcttttaatagacgtgaataaatatcataagatcgttcgcctcttgatgtttgttctacgaccataggaatgacgctcatatatacctcttctaaaaaatctaaataacaaaagtgcggtcattcttacaaaacgaccgcacttaaaactataaaaagctataaattacgcttgagggttcattacttcatcaaacgaagacgctttctcagttacctgtgctttcgttaatacagcatcaacagcttgttgttctaacacgacattgcgaatgttattcattaactctttgtttttactataatattcaatcacttctgctggttgttcataagctgatgcaatatctgcgatcatcgctttaacacgttcttcatcagcctttaactcattagaagagatgacttcagagaataataaaccaacctgaacacggcgtttagcttgttcttcgaataattcacgtggtaattgtgcagcttgttgagcattaccgccaaaacgttgtgctgcttgattacgtaatacttcaatttcttgctcaactgcggcagtaggtacttcaattggattttgctctaacaaaccgtcaattacctgagttttaatacgagaaaccaaagcatttttcaattcacgttgcatattttttgcaatttcattgcgtaaatccgctacattttttgtattagggccaaattttgccacaaattcatctgttaattcaggtaattgcattacttctacttttttcaaagtaatcgaaaatttagcagctttcccttttagattttcagcatgataagtttcagggaaggttacattaatttcaaattgttcacccgctttatgaccaatgataccctcttcaaaaccaggaatcatccgaccttgccccattgctaaaacaaagtctgttgattttccaccctcaaactcttcgccatcaacagagccaacgaaatcgatagtaacacgatcatcagctttagcaacatcttgagtttcaatccaagttgcttgttgtttacgtaaaatgtcaagcatcttatcaatatcggcgtctgaaatttccacaaccggtttttcaaccttgattttatccagtccttgaagctgaacctctggataaacctcaaaagtcgctgtaaattttaattctttaccagcttcaaattgttctactgtaaattctgggcgaccggctaaattcactttattttcaagcatcacattgaaaaaatgtttttgtaataaatcgcctaatacatcttggcgaacagatgcaccaaaacgtttttcaatcatttgtgccggtactttacctttacggaaaccgtcaatacgtgcattttttgctacacgtttcaattcttcacgcacagcttgctcaacagcttcagaaggaacggtgatatttacacgacgctcaagaccttgagttgtttcaatattaaatgacattatgttacctcaaaaagaatttgtactcggcggaaacacgcaccgaacacgttagtaaattaaatttacattaaaagacgaggaattatagcgatacaaaagcaaacagtcgaggaaatgacaaataaaaatctgcatttgaacattttttagcctaatagataaaatttttttgccaagaaatttttccataattttggttctcctgttgagaaatataaaatttctgatgttcgcatatcacaaaaagttatttttacgatctggatcgtaaaaaaagtgcgatggtattttccatattttctttttgcaacaaaattctcagtacatcattaaccaaataatataaacgcacaatatgataattcctcaatctgaagatatgtctccgatagtgatgtcgctcgatggagatacttatgaaataacaccgcacttatggcaaagaaatcagcaacaatcccaaattctgctacgctattttgccattcctttacaggaaaatgaacaaacgttatggttaggcgttgatagtctaaataatattagtgcctgtgaaacatttgcatttttgtatggaaaaattgtagaaccggttttacttaataaccaattacttaaacagttactacaaaacttatcaccacagcaaaataatatgttcgttgaagagcaacctataaatcaatatgtagccgagcatcgtatagaagtaactgaaaagtctgatgaacccgtgattcaacttttagatcacatttttgaaaatgcgttaaagcaacatgtatcagatattcatattgaaccgcaaatgaattgcttgcaaatacgtttcagaatagacggtattttacaatgccaatcgcctcttccgctttcgctgagtaagcgtattctttcacgtttaaagttactggccaaattggatataagcgaaacacggttacctcaagatggacgatttcattttaaaacaacattttctgacatccttgattttcgtttatcaacccttccgacgaatatgggtgaaaaagccgtgttgcgtttacagcaaaataaacctgtacagttgagttttgcggaactcggcatgacagaaaaccagcaaaaatcattcaaacaggcactatctcaacctcaaggactcattttagtgacaggcccaacagggagtggaaaaagtatctcactttacaccgcacttcaatggctgaatgataagcacaaacatattatgacagcggaagatccgatagaaattgaattgaacggtatcattcaatgtcaaataaatccgcagatcgggttagattttagccggctgttaagaacttttcttcgtcaagatcctgacattattatgttgggtgaaattcgggataacgaaagtgcaataatggcattaagagcagcacaaaccggacatcttgttctctcaactttacatacaaatgatgctccgtcggcagtctcacgcttgcttcaattaggggtaaagcaacatgaaattgacaatagtttattattggtcatcgctcaacgtttggtacgaaaaaaatgcccacatacagaaaatgaaaattgcacttgtcatcagaaatatcaagggcgaattggggtttatcaatttttacaaccgcatctaatagataatcatatttgctaccaaacggattatgctcatttgcgtgaaagtgcaatggaaaaagtgcggttagaaataacagatttagcagaagtggatagagttattggacaaagtaatgaataaaaaacggatcttcatgatccgcttttaacctatttaaactttttcaactttaacttgtttaatcatattatccgccacttctaatacagtaatttttagcccatttatttcacattcagttccctcattaggaatttcttctaaatgttctaaaatcaatccattaaaagtgcgggcatcttcggtatctaaattccaattaaataatttatttaaatcacgtaaattggcagatccttcaataattattgttccgtcagattgctgtgtcacttcttcatcaatagatggggcggttgaagtggtaaattcaccgacaatttcttccaaaatatcttctaacgttacgagtcctttaatatccccatattcgtctacgaccaagccaatacgttctttattgttgcggaaattaagtaattgagtattcaattctgtcccctcagggataaaataagtttcatctaccgcacgaatgagcgtttctttactaaattcatttttatccagcattagacgataagcctcacgaacccgtaatatacccagtacattttcatcaatactgcctttataaagtacaacacgcccgtgagcggcatgattcagctgacgcataatcgctttccaatcatcatcaacatcaataccggctatatcattacgtggcaccataatgtcatcgaccgtaactttctctaagtctaaaatagaaagaagcatttcttggtgtgcagaagggatatattgacccgattgatttactattgcacgtaattcttctgagttaagagaatgtgcttttacttcattttttaaacgaaaaagtttcattagcccgctaataaatagatttataataaaaactaatggactaaaaattttcaatagtatgctaataatatgacttgaaacaaaagcaactttctcaggataaagtgcggcaatagttttaggaaaaatttctgaaaaaattaacattacaaaggtcaataaacctgtcgcaacggcaacgccaacatcaccatatatacgcatacctataatggttgcaattgctgatgcggaaatattaactaagttattgcaaattaaaattagactgaggaaaacatccgttctcttaagcaatttctctgttttttgtgcccctttatgccctttttctgctaaaaatcgcatacgatagcgattaacggaaagcactcccgtttcagaaccggaaaaataagctgagagaataagtaagataattaatgtaataaataaggtactaagggggatactatccaaaatataatcctttcattcatttccatgatgccatagtatttttacttatgacgatgacaccaagacattttataactctaaaataacacgactaccgaaataagcgacagtgagcaagatcatacctgaaattgtataaataatcattctttttcctcgccaatataatttccaatgtccaaataaagctataccgaaaacaaaccaagctaaaaacgaaaaaatagctttgggaatattatgcactgagaagaaatcgactaattgaatgctaccggaaataagtgtcaaagtaagtaatatttgtccgctaaacaaagagcgaaagaaatgtttttcaacggtcattaatggaggaacaaccggcgagaaagttaattttttactttttaagctattatcaatccagcgtaattgaatggcatacaacatagcaataaaacaaacggaatatgcaaataaagataaggcaatatggaataataaacttgtattttgacttaaatgataaacccaaatttcaggtaataatgcttgtaaaattaaattgataatagaaaaacagtaaactataggcaacagaaaccaaagtgtttttactcgagccaaaatggcaacagttgcaatagcagcaatcatggcactcactaacgagcaaatttcaattaacgtgaaattattacctatgaacaaatgaataaataacttatttaatgcaataaaatggctaataattgcgatgagtgcggtgactaaaaaagccattttattcaatttaacttcttgaccgccttgccctaataacattggcatgattaataaaatgctaattaaataaaaaaaagctgaaataaccgcaaaccacataaatttaccttacacaatatataataatagttcttattttaacttatccgcttgataaaatcgctataaatttcttgcaaatgatgaaaatctaccgaatttcagtataattatgacagtagttttttcaagaaaatataggataagaaatgtttgaaaatttatcggatcgcttgtcaaaaaccttgcgtaatattaccggaaaaggtcgtttaactgaagataatattaaagatacattgcgtgaagtcagaatggcgttattagaggctgacgttgccttacctgttgtccgtgaatttattcatcaagtcaaggaacgagcgattggcgaagaagtcaatagaagtcttactcccggacaagaatttctcaaaattgtccaaaccgaattagaaaaagccatgggggtggcaaacgaaaaactcaatttagccactcaaccaccagctgtgattttaatggcaggtttacaaggtgcaggaaaaacaacctccgtcggtaaattggcgaaattcctaaaagagaactacaaaaagaaaataatggtagtttctgttgacgtctatcgtccggcagcgattaaacaattggaaaccttggctcaatctatcggcgttgatttttatccttccaatgtttcacaaaaacctgttgaaattgcacgtactgcattggctgaggcaaaactaaaattctatgatgtcttaattgttgatactgccggtcgtttgcatgtagatgacacaatgatggaagaaattcagcaaattcataccgcacttaatccaattgagaccctatttactgtcgatgctatgacaggtcaagatgcagcgaatacagcaaaagcatttaatgaggcattaccactgacggggatcattttaacgaaagttgacggtgatgctcgtggtggtgcggcactttctattcgtcatattactggaaaaccaattaaattcttaggtgtcggtgaaaaaaccgaggcacttgaaccgttccatccagatcgtattgcttctcgtattttaggtatgggtgatgttctttctttgattgaagatctacaacgttcagtcgatcaagaaaaagcagaaaaaatgacacaaaaattcaagaaaggagatagctttactcttgaagattttcgtgaacaacttatcgaaatgaaaaaaatgggcggaatgatgtctatgttggaaaaaataccaggtgcgagaaatctccctgatcatgtaaaaagtcaagttgatgataaaatgttcaataaaatggaggcaattattaattccatgaccttaaaagagcgtgctaatccggatattattaaaggttcacgccgacgccgaattgcattgggatccggtacacaagtgcaagatgtgaataatctgttgagacagttcaatgaaatgcagcgtatgatgaaaaaaatgcgaaaaggcggtatggcgagaatgatgcgtggcatgcaaggcatgatggggggattaggtggattaggaaatatgtttagacgctaatatccacatatttatagggcgagttggatactcgcctttcttttattcagtttttgttaaatctctaatcttgcgatagaccacgtccaaattcgtactaaaatgaattttatgtatttctttcactgtcttagatttaacaatagttcttaagggttggaactgcatattgcacatatgcaattcttgtgaaggcaacatatgttggataaaacgggtcaaagcatgaattcctccagcatcaagcacagtcactgcatcacattgcaatacaatatgtttgatctctttccctgtatgagtagttttttcatgtaagtcggcaaacaagttatccgctgcggcaaaaaagagcggtccgctaatacgaaaaactacggtatcacacagatcctcaggatgtgcaatttcaaaagatcttgtcatttcagcaatagtacggataaacaatagacttgctaaaagcacgccaacggtaattgcaattaccatgtcaaaaatgacagttaaagttaaacaagtcagcaagactgcaatttcattcaaacctgatcgacggattaattgaacaatttgcccaacgtttgccatattccaagcaaccacaagcaacaacgcagacatagaggcaagcggtaaataagacaatgcttttgcaaaaaataatagagagaataaaactaataaagcatgtatcacactggaaataggtgacaccgcccctgatttcacattagccgcagaacgagcaatagctgctgttgctgtaatccctcctaaaaatggtgcaacgatatttcctaacccttgagccaataattcattattagaatggtgcttagtactagtcatattatccaatatcaccgcacaaagtagagattcaattgcacctaatactgccatagaaaatgccgccggcaataaggcctgcaaggtattgaaatcccaattgatcacttctccatcagcattgggaaaattccaaggcaaaataatttcgggtatgacattcggaataccatatcccgtactaccgtctgataggctataactaaaagaagagcctattgttgccacatcaaagccaaaatgaatcaatgcaatggataataacgtaccgataataacagcgggcagatgaccgggtataggtaaacgaaatttatgccattttgtcagtaaaattagcgttacagttccgactgcagtatcagcccaattaattgttggaagtgcggtaaaaattgcttgcaatttgccaaggtaatgtaccggcattgtggcgacattcaagccaagaaaatctttaatttgcaatgtcgcaatcacaatcccaattccacaagtaaaaccaagcgttacagagagcggaatatattcaatcaaacgacctagacgaaaaaaagccattaaaattaaaataatccctgacaatagagttgccatgagtaacccgcttaacccaaattgctgcgtcacagggtataaaatcaccacaaatgccgctgtagggccggaaatattaaaacgagagccaccggacagagcaatcactatcccagcaacaatagcggtatataagccgtgctgaggcggtacaccgctggcaatagctaatgccatggacaaaggaatagcaataacaccaacagtaagtcctgcaataatgtcctttataagatgcgacttaccatagccaattttaaagctatcttgcagtgcactaaaaggacgaacagcaagaaaaatatttttagttaaaaaccacttcttcaacatataaattccaacagacaagatgatagagagaagtattgtaactgaaatttaagctaataatttgttttagcacaagaaaaataaaaaatacttgactgaattagaagaaatctttatatttgccgccctaacttcaatggtgagatgtccgagtggttgaaggagcacgcctggaaagcgtgtatgtgggaaactgcatcgggggttcgaatccccctctcaccgccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacctgcgattattcagcgtacagatcgcttgcatcccgatctttatgatttatattgcgtgtgtaaaaatcctgaatgtggccatacttggaaagcacaatataatttttctcattctttgcgtcctacacaattagaccgtgatgaattggtcaaatatttaattagtaagatgcctaaaacagagcttgagcaactgggaagggatatagaacagcagttaaagttggcaatatagccgtaattttaggcagtcaacatcaaggctagtttccttttgccttggtaaaggcggaagatcataacctccgccttttttcttggtgactgggatatgtttaaatggttggtatattttcataaaactttttcggttcacaaccgcataacatcatcatcttagcaatgatattccgttgtttttgttcctcatgaacaggcaatttaaaacgctttaaatcttccgctttaaaattcaatccttgcttatactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgggtgtaatcttggtgctgccccttagggttcttctatcgtttttgctatcggctccaatcgcttactctgtatttcgtcaatatcgtcaatagaacagaataattgcgttagtactatgtctagtattttttcttgagataactgaacctcttgcccctcgtcattaaaagccattacgggctttttctcttttaactgaataattaaatctcttgaggtttctaatgtgttcttaataccctctaaatcgggcttaaatgcgttttcttggtttgcttgataatttgtattactcatcatctaaatctcctttatagcttgaatatgcagctttaagcgtggtgatttcgtttgataggtttcgcatattaatcaccctcttttaacatattttcttttgcgttttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccctctcaccgccatttaactgtaaaataatgtttgtcttgtaaaaaacaattaaaaaatcaataagttaccattccttaattgttcacattgtaaaataatgtttgtcattgtaatcgcttgatgttcccttttatgttccttttttgagagctaaaaaagtaacagcaacgttatttttatgtagagctaaaatctatgtaaacgtttgcttaatgaaagcgggctgcggtaaaataacccgattttatttaaagctaataaggtattcatatgacacagctaagtttgaaaaaaatttattcggggaaagtacgggatctctatgaaattgatgataaacgcatgttaatggttgcaacggatcgtttgtcggcattcgatgtaattttagatgatcctattgatcgtaaaggtgaaattttgacgcagatttctaatttttggttcaagaaattagcccatattatgccaaatcattttaccggtgaaacagtttacgatgttttacctcaagccgaggcagatttggttaaagatcgtgctgttgtttgcaaacgccttactcccatcaaaattgagagtatcgtacgaggctatttaacgggatcaggattgaaagattataaagccactggcacaatctgcggattaaaattgccggaaggtttggttgaggcaagtaaattacctgagccgatttttacaccttcaagtaaagcaaaagtaggtgatcatgatataaacattagctatgcggaatgtgagcaattaattggcgttgagcttgcaaagcaagtacgggaaaaagcgatttcactttataaagaggcagcggaatatgcactgactaaaggtatcattatttgtgatacgaagtttgaatttggtttagatgaaaatggcgtattaaccttaatggacgaagttttaacgccggattcaagtcgtttctggtctgtggaaacttatcaagaaggcactaatccgccgtctttcgacaaacaattcgtgcgtgattggctggaaaagagtggttggaataaacaggctcctgcacctaaagtccccgctgatgttatccaaaaaactgttgataaatataaagaggtattggatttattaacaaaataattggaagtgcggtgaaaatttgttaaatttgaccgcacttttgccatgaaataagtttgagataatatgagagctgtttcaatcgtagggttagggtggttaggtttaacacttgcccgtcatttaaaaaatttgggttggaaagttaaaggcaccaaacgcacacatgaaggcgtggagcaaatgcgtttaattcgattggaagcctatcatctggaactcacacccgatattaatgctgatcccgatgatctaacagcattactttctgtggatgctttagttatcaatattccaccgagtcaatatttttttcatttacaacactacgtacagggcgttaaaaacttagtgaatgaggcattgttaaacggtcttcaacatattatttttatcagctcaacctctgtatttcctgatgtttcaggcgaatttgatgaacaaagtcagattgtaccccagtcagaaatgagtaaagcattgcttgaaattgagcaatggctgtttgagctgaaagatgttgactgcgatattattcgttttgggggacttgtgggcgaggatcgtcatcccgtttattctttagcgggaaaagatgaattatcagcggggaatatgccgatcaatttggtgcatgttgatgattgtgcaagagctattcaattgttattggaaacaccaagttcccagcgtttatatcatttggtcgcaccgcaacatccgactcgagcagaatattactcacagatagcagaaaaattagcactggaagcaccgcactttatttgttcggaacaagatccaagacgtgttattttagcgaataaaatttgccgagagctcagttttgtttatcagtgtccagatccttatttgatgttatttgaaagaaaataaaaaatatccgatttgcatttttaatcaaaaaaatgcaataatatgcagaatttattcaaaaaaaaatctataatgcaaaaaagaaggtcataaatgtcaaatacaattttacaacatcttccaattggtcaaaaagtaggcattgctttttccggtggtttggataccagtgcagcattactttggatgcgtcaaaaaggtgcagtaccttatgcttataccgctaatttaggtcaacctgacgaagaagattataatgctattcctcgtaaagcgatggaatatggtgcagaaaaagctcgtttaattgattgccgcaatcagcttgctcatgaaggtattgctgctattcaatgcggagcctttcatatttccacaggcggtgtaacgtattttaatactacgcctttaggtcgtgcggtaacaggtaccatgcttgtttcagctatgaaagaagatgatgttaatatttggggcgatggttccactttcaaaggcaatgatattgagcgtttttatcgctacgggttattaactaatccgagtttacgtatttataaaccttggttggataatcaatttattgatgagctgggtggccgtcaagaaatgtccgagtttttaatcgcaaacgggtttgattacaaaatgtctgttgaaaaagcttactcgacggattccaatatgttaggtgctactcatgaagcaaaagatttagaatatctcaatagcggtattcgtattgttaagcctattatgggtgttgccttttggcgtgatgatgtaactgtgaaagcggaagaagtgacggttggatttgaagacggtgttcctgtcacattaaacggtcagtctttttcaagtgcggtcgaactctttttagaagccaatcgcatcggcggtcgtcatggtctaggaatgtccgatcaaattgaaaatcgtatcattgaagcgaaaagtcgtggcatctacgaagctccgggtatggcgttattgcatatcgcctatgagcgtttggttacggcgatccataatgaagatactattgaacaatatcgtatcaatgggttgcgtttagggcgtttattataccaaggacgttggtttgatccgcaagcattgatgttacgtgaaacagctcaacgttgggtagctcgtgcggtaaccggtgaagttacattagaattacgccgtggtaacgattattctattttaaatacagtgtcaccgaatatgacttatcatcctgaacgtttaagtatggaaaaagtggaaaatgcaccgtttgatccgtccgatcgtataggtcaacttaccatgcgtaatcttgatattacggatacgcgtgataaattgggtatttatacacataccggattactgactgtaggtaaagattcaatgttaccgcaattggataaaaaatagtttttttacacgccgacatagttgaccgcacttttaagtgcggttagtttttgctacaattctccgttttaaaacaagcaggttatacaaacgacggattcatctgataatgaaaaatttattttcttttccttctttctatcagttttctaatgaaagacgttttttaaaacggttaagaactcgtattcgctattatttttatcgtttaacttgttttaaagaatgtcagatttttgttacctatttaaatcataatcctctttggattgatatattcacgaaaagttacaatcgttgtgatgctgtgcttagaaagtattgcgataaccgttttaataaaaaacaacgtgtacaagcaattatggataatttttccgtagcagaacaagtatttgggcggtctttctcacaactgttagttgaaaaagataaggttttattggctgaattaacagatgagttggatttgtatttagcaattaatcaaatagatccttttgaggggttttttgcggtaaatattcgcaataaacagggtcaacgtatttacgatgcctctttttcttttttggcagggaataaattattgatcacgtctgtgcaaggacctagtgatgataattcacaagaattaattaaatcgacaacgaagcaattacatggtgtacgcccaatgtttatgttggtaaatgtgtataaattgttagcaaaagagctgaattatgaacttttaggcatagcacataaaaatcaaggaaaatatcgttggaacgacaatgcacgtttgttatttaattatgatgatttttggcaagaaaataatgcacttttaaaccctcagggctattggcaattacctgtagttattgaacgtaagacgctggaagatattcaaagtaaaaagcgttccatgtatcgcaagcgttatgaaatgtttgattttattgaaaaaaatataactgagatttttggaaaagaaaatttgaataaatagaccgctctatttggtattcaagttttaaatggcatataatgagttgctattgatttttagtttgttttattaatttaaaggtatgactgtgacaactgaacgtattgcaagaataattgaatcaaaagaaattatgacacttctccctcatcgctatccgtttttattggtagatcgtgtaactgattatgaagaagggaaatggttaaccgcaattaaaaatgtgagtgtaaatgaaccttgttttacaggtcatttccctgaccaacctattttgccgggggtattaattttagaagcattagcacaagcaatggggattttggcgttcaaaactcacgagttaagtaataaagagctattttattttgccggtgtggatgaggcacgttttaaacgtcctattttaccgggagatcaaatgatgttaaaagttgaagtcattagggaacgccgtggtattaccgcttttacaggtgtggcgagtgtaaatggtgaagtagcttgtgaagccaaattaatgtgtgctcgtagataattaaggagcaaaaatgattcattcgactgcaaaaatccatccttcttctattattgaagaaggtgcaaaaattggtgaaaatgttgttattggtcctttttgtattgtgggaagcgatgtacaaattggtaaaggtaccacgttatattcccatgttgtcgtgaagggagtaactaccataggggaagataaccaaattttccaatttgccagcattggtgaagtcaatcaagatcttaaatatcaaggtgaaccaacgaaaacgattattggtcatcgtaatcgtattcgtgaaagtgtgactattcatcgtgggacagtgcaaggtggtggtgtaactcgtattggtgatgacaacttgttgatgattaatgctcatattgcacatgattgtcaaattggaaatcgttgtattttagccaataatgcgacgttagcaggacatgttgaattaggtgattttgttattgttggcggtatgtcagccattcatcaatttgttattgttggtgcacatgtaatgctaggtggtggttctatggtaagtcaagatgtgccgccttatgtaatggcacaaggcaatcatgcacggcctttcggagtaaatatagaggggctaaaacgtcgtggttttgataagccgacactacatgcaattcgtaatgtgtataaactgatttatcgcagtggcaaaacccttgaggaagtcattcctgaaattgaaaactatgcacaaactgaaagtgcggtaagttttttccttgactttttcaatcgatcaacacgtggcatcattcgttaatgggtagcctaaaataatgttgtaataaaataggaatgaaccgcactttttttaagtgcggttattttttatggtgtttttatgatagataaaaaaaatataacaattggcattgtcgcaggcgaagtatccggtgatattctcggtgcaggtcttattcgagcgttaaaaatacaatatccacaggcacgttttattgggattgccggtaaaaacatgttggctgaggggtgtaaaacgttagttgatatggaagaaattgctgtcatggggttggtagaagtaatcaagtatttgcctcgtttgctgaaaattcgtcgtttagtcattgataccatgttagcagaaaagcctgatatttttattggcattgatgcaccggattttaatttggatatagagttaaaactcaaaaagcaaggcattaagacgcttcattatgtcagcccttctgtttgggcttggcgacaaaagcgtattttcaaaattgctcaggcaacgaatttagttcttgcttttttaccctttgaaaaagcattttatgatcgttttaatgtgccttgtcgctttgttgggcataccatggcagatgccattgatttgcaaccggatcgccaagatgcttgcttccaacttaatctggagccaaaacatcgttatgtggctattttagttggaagtcgagaggcagaggttcaatttttaactcccccttttttacaaacggcacaattaatcaagcagcgttttcccgatgttcaatttttagtgcctttggtaaatgaaaaaagacgtaaacagtttgaacaaattaaagcccaaattgcaccgcatttagaggtcatttttctagatgggcaggcacgccaaacgatgattgttgctgaggctagtttacttgcctctggtacagcgtctttagaatgtatgctatgtaaatcgccaatggtagtgggttataaaatgaaaccttttacttactttcttgcaaaacgtttagtgaaaacgaaatatatttcgttaccgaatttattagcagatgacatgttagtgcctgaaatgattcaagaggattgtactgctgagaaattagctgaaaaattatctgtttatttggagcaaacggaaagtgggattaaaaatcgccaacatttaattcaacaatttactcaattacatcaactgattcgatgcgatgctgataagcaggcggcacaagcagttattgatttattaaatgatgaggtataaatgacaaatgtatttatttatccgaatgtggaattcattgcaggcgttgatgaggttggtcgaggacctttagtgggtgccgtagtgacggcggcggttattttagatccgcataatccaattgaagggctaaaagacagtaaaaaattatcggaaaaaaagcgtttgcttttggctgaagaaattaaacaaaaagcgttagcttggagtttgggacgggcagaaccggcagagattgataagttaaatatcttgcatgccactatgttagcaatgcaaagagcggtagaaaatttgaaaattcaaccgcactttgtattggttgacggtaaccgtattcctcaattgccgatgtcggcacaagcggtgataaaaggcgatagtttggttgctgagataagtgcagcatcaattttagcaaaagttgctcgagaccaagagatgatagaactggatagacgttatcctgagtacgcttttgcacaacataaaggttatccaacaaaattacatttggaaagattagctcaattcggggtattacctgaatatcgtcgtagttttgcaccggtgaaaaaattgttatcaactttattgtcaaaaaatcacgagtacattttcaaaatacaaaaataaatattatgttagaacctgttattgagtataatgagaactcagttttcaaaaggaaataatatggctacgcttttaaaaattggcttagtttcagtctctgatcgagcatcacaaggtgtctatcaagatcaaggtattcctgaactgcttgaatggttaaaatctgctttatgcgatccgttcgaagtggaaagtcgcctaatccccgatgaacaaaccttaattgaaaaaacactttgtgaattagtggatgattgccattgtcatttggttttaactacaggcggtaccggtcctgtaaaacgagatgtaacacctgatgcaactttggctgttgccgatcgtgaaatgccaggattcggtgagcaaatgcgtcaagtgagtttgcattttgtgcctactgcgattttatctcgtcaggttggtgttattcgtagaaatagccttattttaaatttacccgggcaacccaaagcaattaaagaaacgctcgaaggtgttaaagatgaacatggtaacgtcattgtgaaggggattttcagtgcagtaccttattgtttgcaactgattgatgggatttatattgatacagatcccaatgtaattgaaagttttagaccgaagtcggcaagacgtactttatagttgaaaagtgcggtagcttttttattttgtttgaggaagatgatgaaaaaaattgaagcaattattaaaccttttaaattagatgatgtacgtgaaagtttagctgatatcggtattaccggaatgacggtaacggaagtgcgtggttttggtcgtcagaagggacatacagagttataccgtggtgccgaatacatggtagactttttaccaaaagtcaaaatggagattattgtgcctgatgaaattgtcgaacaatgtattgaggcaatcattgaaaccgcacaaaccggtaaaattggtgacggcaaaatttttgtgtatgatgtaaatcgtgtcattcgtattcgtacgagagaggaaaatgaggaagcactttgatgtctgaaagaaattcatcgctaactcaagtgctggttgcttgtgctgcaattatcgttattttaggtggcattaaactcgccagtgagattgttgtgccatttctattatcgttatttattgcgattatttgctcacctgtggtgaattttatgactaaacggaaaatacctcattggcttgcgattactttgctttttgtattaattgtggtgttattttattttttagccagtttaattagtaatactgttcaggagtttactcaatctattcctcaatacaaggtactgttgtcacaacgtttaaatgatttgttagcttttgctcatcattttaatattcctttatttttttctaccgatagtattaatgatgattttgatcctagcattatcatgaaatttgtcagtcgttttttgttgagcttctcgaatgtggtaacaaatatttttgtgttgtttttgatagttgtctttatgcttgctgaagcacctactgtaaagcaaaaatttactaaattaatcgttactgaaaatactgttactcaacaaaattatattgaacgtattctacaaggcgttatcggctatttaggcgtaaaaacgattactagtgtgatgacaggattgtgcatttactttgttttatccgtccttgatattcaatatgctattttatgggctaccttggtcttcttattgaattatattcctaatataggatctatcattgcggcagtccctgttattgtgcaaagttttttattaaatggatttatcacgggtttagttgtcagtattgcatttattttgattaatactgtggttggtaacgttttagaacctaagatgatgggcagaaaattgggactatcaactttaattgtttttctgtcacttttattttggggttggttattaggaacagtaggaatgttgctttcagttcctctaacaatgggattaaaaattgcattagaggcaagtccaaatacaatcaaatatgctgagttattaggtgatgtaagcgatgtgcaaaatgttaaatgacgaaaatttattttttatnnnnnngtgccgtaaaaccacgtcctttagggcgtagatataaggcacaaatatgatatacttcttactgctaacagaggtcgctttagactctcaatgacggcataatcagggcaggacgtgcccgtagcgtctgtgaagtgaatcgcattggcggtcagcagcagaaacccaccgagagtagcccattgcttgcaatgggagctggtaggaatctccttgctttagctaggggaggacgtcaattgacgcaatatatctacaaaaggcatctttcttttcagatgccttttatcttataaaaacttctctttgtactttactaagtcttttttatgtagtgcaaagacgcctattccgccatttcttaattctaaccattggaaaggcacctctgggaattgttcgattaaatgaaccatactattgccaacttcacaaattagtattccattatcagtaagatagtcagcagaatttgccaaaatttctttagtaatagtcagtccgtcaattccggagcctaaagccatttccggctcatgatgaaattctataggcatatcctgcaaatcttcttcatccacataaggtgggtttgtgataatcaaatcatattgatcgagcggtaaatttttgaataaatctgactgaatagggaatacacgatgggtgaggttatgacgttcgatattgatttcagcaacatttaatgcgtcaatagataaatcaaccgcatcaacttctgcatgggtaaattgttctgcacaagcaatagcaatacagccacttccagtacaaagatctaaaattctgattgggtcttgttggagtaaccctttgaatttattcgtgattaaagcactgattggtgaacgaggaataataacacgttcatctacataaaattctaatccacagaaccatgcactattagttaaataggcgataggtaaacgttgctcaattctagcaataactaattgaatgagtgaatttttctctgaagtcgtgagtgctgaattataaagtttttcgggaaaatctagggggaggtgtaatccggttaaaatgagctgaagactttcatcccaagcattatcataaccatgcccataataaatatctgaacggttaaaaatgctataggtccatctgagaaaatcttgtattgtatgtaggctgttctgaacctgatctgttaaaatgcaatctacaagttcttggttaaactgatttatggtactcatattaattctctcaatcaaataaacggcgtagttataccatagttattcataatgagtaagttaaatttaaaaatagggaaaagtatgttaaatgatgaagatatagaattatttcatcgtgaaattcaaggagcaaaaaagatagaacagaatatttttattgcaccacgtcatcgaaatttaaaaaataaagtggagattcgcaatgttcgagaaaaagaagataccttatttttcttttcagatgaatatgaacctttattagatgaagaaagtgcggtgaaatatttacgtccacatgaagatcgttatttgttaaagcaattacgccgtggtgatttctcgcctgaactttttttggatttacatggtttgacacgtaaagaggcaaaaattgagctggcaagccttattcatgcctgtgaaaaggaacatgtttattgtgcttgcattatgacgggatatggaacttatacattaaaacaacaaatacctcgttggctagtgcaacatccaagagtaagagcgttacatcaggcacccagagaatggggaggcgacgctgcaattttggtattgttggacgtttagattatttgttagcatcaagtttagatgtacgttgattttgccggaaaaccgtataaagtgcgggtaatatttggttaatcagattaagttgttgcaatggaattgcgacttcatttcgattgaactgatcagcatgttcatcactaaattgttttaaagaaaactcaatatttagcaataatttttcaaaattatctcgttctaaagtttcaatatgctcaaggacatgaagtaattttttggcgataggataaaactcccctaaaaacaccgcactttgctgaattttctgcatattttttctatatgcacctaaagcagaaatataactcagtagcgaatagttaattttgaccagttcaaatccttcttgcaaataggcttgatattttttaggttcgctattcatgtttgatagggttgtacttaatgcggttgcatattcatgtgcttgccgtctggcaatacgatattttagcggatcacctttgccgaataatagttggctaatgatatataaaaagtatttagcattagcttttatcgcttgttttatcactttatttagttgtagatatttccaatccggccataaataagaaacagcactccaagcaataaagctacctattaatgtgtcggttaagcgagataatagagcgttatttaaatcaaatcccatgatattaaagctaattaagacttgtagtgtaataaaaaaagtagagtagctataattattgctacggaaaaagaaaaacaatgtactagtgacgacaactaaacctaattgcaattctaaagttggatgtatgtaaggcaatagagaaccgattaccacgccaagaattgtaccaatgatacgttgttttaatcttaacttagtcgccgaataattaggttggcatacgaaaacagcagtaagtaagatccaataacctaattgcaaattaaatatttctactaaactacagctaacaaaaacaatgatagatagacgtattgcatggcgaaaaagttgtgattcaaaggtaaaatgactacaaattgtacgccacatattttttaaaccaatgatctgctctgtatatatttgcgttccttcagatcgttcatttgtattttccgaatattgatccatatggtgtaattgccaattaactgcctgtaaattatcgattaatgttttaatggcaagtcgttgtaattgatttaagtgactgttttgataatgtatttcaaacgactgattaatacctaaaatcgcttgttccaaacgaggattgtacgaataggatttattgtattgcagactatgagcaatttcacgacaagattgtgcttgtagctctaataagcgttggatacgaaaaataagatccgtattttttaattgctctgataattgttgataattaaaatgacttgaattaattcgttcatgaatatcttgtgcagcaaaataatatttaatcatttttgtcgtacggcgatgtttatgttgtccacgaatgcgatgaaataatgctgtacgacaagcgttaaaggcagtaattaaattaccgtttttcatggcaagaatgacacgtttattttctaattgttcaatatcatcaggatcaaaaaaaagtgattttgtgtctaaatattctgataaagcaagaaaagcttttgtcatattttcttgtacagggcgatttggaaacattaaatgaacaaaaaccgtgcataaactataaagtaatgtgccacataaaattaaaatagggttgatataccaagaaacatttggtgtataagttaatgttgtataaagagctacaacgagtgtaccgaaagcaatagtgctataactttgccctatagcaccaaccatggtaaataaaaaggtaagagcggtcattaataacaaatattcaattccatgccctaaggtgagttgtacactaagagaggaaatagaaaaagcaattaatgtataaaatacatatttaagtcgtcctgttaatctattatccaaatcaactagtccgcctgcaataatacctaaaattaatggcatagactgttcggaaatatttagtttccaaatagagaatgtcactatatttactgctaaaaaaacaggaatggagagaatgatttttgtattaatccaaggggtcattttatattttttctaaactttttattattttaaccgctcttttaagtaaccttgatagtctagaatacgaatttcagtttcttgttggaatgcaggagaactaattaaaaaatcagcagtagcaatattcatcgcaacaggaatgttccaaacagttgcaatacgcattaaggctttgacatcaggatcatgaggaaccgcattcattggatcccaaaagaatatcagcaagtcaattttcccttctgcaattaagccacccaactgttgatctcctcccataggaccgctaagtaaatttttgatttctaaattcgtttcttgatgaattaaatttccagttgtccccgttgcataaagaacatgaggttgaagtaaagtgcggttagtttgacaccattgtatcaaatcttgtttgcagtgatcgtgtgcaaccagagcaatttttttgttttttgtcaatttgcgataggtggtttgcataatgatagtccttaataaaaaagtgagcttaggcccacttttgagttaaaaaccggttataaaattatttttggttttttgcccaattgaggaagcgaacttgagtttctttgtcggcttgttggaaccaaaactgtaattgttgctccgcaatattttcaccttgcacgacgacttttcctttttgtgctttagcaaatccgagagcaacagcaggcattgccgttgcaaagttggaaactgaagcaacagaaccggatgcattatattcagataatgtatcaattaggttagcccctggaaggaaaccttcttgcttcagtatttcttgttttgtcgcaattatttttccgctatttgttttgacgatgacagacggtgaatctttaaaatttttaatatctcgttcattttccagtttaggggctgagataactacgtcttcgtttgtgccttgaaatgtaacaacaataggatctgattcatataaagaacgatctgagccatgacgaacaatttctgaaacacgaacgacgacttggtgagtttgcgattcattgatattaaatgatttagtagattttaatagatctttattagctttttgtccatcaatagctaagaaatctatgtttgatgaactggttactataccggcaaaagctgctgtacttgttaatagcattgcacttgcaagtgctgcaaaagaaaatttcataattgctcctatagcctcaggaaatataatataaacttatccgcttttagaaaaagctaaccctgtatgctattccaaattaaataaaatgggaatagaaaaaactcgattatttgatttttttctatttttgtagtgaataagtaaaaaaagaaagcaaatttacttcttagttttttttcatttagtatattcaagaagaaattttgacgctgtggaaaaccgaatcataaatgttcgaatcacgatagactgccattctcaaataaaccaactatatagtccctgattgatcaacccgctttactttttattcattttcgaatagactgcctgaaggtgcaatttctcattgattcgtacgatttcttcatttctgtagggctacatatgaaaaaaatgtcggtattaatttggctttgcggtttttcatcattattgtcggcggtagaacgaccgctcctccaattaaatcgtattgatgcccaacagcaacaacgccaaaaggaacaaattcaacagcaaagtgaacgacttcgttccgatcccgatgtgagaatggaaatttcttcagaaaaacctaccgcacttccctttaatgaatctccttgctatcccattcaacatctttccattgtagattattcctccgataacaagacaaaacctagccaatttcaatgggcactgaataaagccgtcacgcaattaaacctccaattaccgcattgtttcggaactcaaggactagggattttgatgaaacaggtgcaaaataatgtgattgaacgaggctatatcacaactagagtggttgccggcgaacaaaatttaacgcaaggcgtattttctttaacggttattcccggtcaagttcgccatacgattattgccgatgtaagtagcctcccttggtttagtaaactgacagctaaaaccgcattggcatttaaacagggagatttagttaatatccgtgatattgaacaatccttggaaaatctcaaacgtgtgccaactgcagatgccaatatcgacattcttccggctgataacagttcagcattcggtgaaagcgatattaaaatcacctatcaacagcggtttccattccgatttagcttaaatttagatgattcgggttcaacatctacggggaaatggcaaggctctgccaccctttcgtgggataatcttttttctgccaatgatttattctataccactttcacacatagcttaaaacatcacagcgataattcggggcgtcgagcaacgagaaactatggcttctattattctattccttttggttattggacactctctgcttcactgtataaaacggattaccatcaagatgtttttggggcgtttgataatacttacctctatgctgggcgtagtgaaacaaccaatttaaatcttgcatatcgtctttatcgagatgcggtacgtaaaaccacaatttcaggcgggttttggtctcgccactcgaaaaactacattgatgatgctgaaattgatgttcaacgccgccgaatggctggttggcaaatcaaccttagccatattgaatatattaaggcagtaacactgaaactttctctaggatttaaatggggaacaggtgtaggtcgcaccatagcggcaccggaagaatattggagaaacggtacttctcgtcctaaaattattaccgcctcggtagacattaattatcctttctatatggggaagcaacccttggcatttaatacgaattggtccgctcaatggaataaaacccctcttattcaacaagatagattgagcattggtgggcgttatacggtgcgtggatttgacggtgagcttaccttatcgggcgagcgaggttggctatggcgtaatgaactcagttggaatattgcaaataaaggacattgggtttacttagccttagatggcggtagagtgatgggacgtagtgatggaatacgattagggcatcatttaatggggacagttttaggtctgcgtggtagttggacgcatttttattatgatgtatttattggacggccattaagcaagccgagcggttttagaacatcgcataccgtaaccggctttaatatcggcttaaccttttaatttagtgcattaggctcaaacgaggattttcttatgaataaacgtcagtttcgtgtgatttttagcaaaacattgcaacctattgtcgtggtttcagaaccggtaaaaaccgaaggaaaaacaaaaagtgagatgcctcaaatgcaaagtgcggttaattttctacccatttttgccgccttaactccccttgtctttcgtttgttctgtgctttgagttttgtcttttcctcgtctgtatttgcggaaaccttaatcatcaaagccgatcccaacgctcccaaaaatcaacaacctattgtgttgcaaacagcgaacggattaccgcaagtcaatattcaaaccccgaatgataaagggctttctcataataaataccaagattttaatgtagacaaaaaaggggcgattcttaataacagccacaaagacacacaaacacagcaagcaggttgggtacaaagcaatccttatcttgctcgtggcgaagcaaaagtgattctcaacgaggtaacatctacacatccaacccaacttaaaggttatgtggaagtggcaggcagaaaagccgaagtgatcatcgctaatccaaatgggcttcattgtgatgggtgcggtacgattaatgcgacacgctcaacaatgaccacaggcaaaccgcagattattgatggacaagtagaaagcattaacatagaaagaggcaaaataaccatcagtggcaaagggttagataacagtcgtgtcaattataccgatattcttgctcgagaagcggaaatcaatgcaggcgtttgggcggggaaaaagcttaatgtggtaaccggcaaaaacaccatcaaacaggcagatatggaacatggcggaaatgatttacaaattacccatattgacagccaaaatctcagtgaaaacgcaccgcactttgctttagatgtgagtgagcttggcggtatgtatgcggggaaaattcatcttgtcggcacagaacaaggactgggggtgcgtaatgcagggcatattggggcaagtgcggacaatttagtgattgattcacaaggtaaaattgtcaatcaaggaatgatttctgcgaagggaaatctacacgtcagtacgaaaaaagaaattcagaaccaagggcaattactcaccgaagctcagctaagtaccaaaagttctcatttggataaccgtggcggtaagattgaaggaagaaccgcacaaattaatgcgaccgagacagtgaataatgatcgcataggttcaacaggatctttgattcaaaccgctgaaaaacttgatattcacagcaaactcgttacaaacaaaaacacgaaagcgtcacaaagtaagccccctgaacaaggtattattgcaggtgtactgacaataaatggcgatgctcttgccaatcaaaacggggcaatttatggcatgcaaaatgttcaacttaatctttcggtacacttggataatcagcaaggcgaaattctctctcttggtgagttacaaattcaaggcgataaacttaatatgaataatgaacatggggaaatcgcaagcagaagtaatttagctatttatgccaataaattagaatctgaaggagaaattgaaagtagccacaatgcgagtattcacctcaagcaagatttaacgcttaataatgctttcaaagtaggcggtaatttagacttccaaacacagggcaattttatcaacaactcagttcttcgtgtgggagagaaactaagcatacaggctcataatatcaataataacagggagagtgagctatctggtaaaaacacccaaattctcagtaatgaaataattaatcgaggattaattgatggtgaaaaaaccttattaaaaagcaccgcactttctaaccttgggacagggcgaatttatggcaatcatttagccattgcgacaccaaatcttatcaatggaaaagaagacaatgcttcgccaaccatcgcagcacgtgaacgattagatttggcggtcggttcacttatcaatcgtgatcatgcgttaatttttagtgcgggagagatgggcattggcggtcatcttaatgaacagcaccatgctgaggggaaagcttcattcattgataatggcagtgcgactattgaggctttgggaaatgcttatgtgaatacagcacgcctacaaaatcacgacttacacttgcgattgggggaaaatcacaccgatgaacggcgagttgaatatgcaccgaaaaatacgtctcgacgctatgtattgatagataaagatggcaatcacgggcgatttgattcaagaaataatagtaggagcgatagaaattcttatttaaggctgaatgacggcacaaccattgcggctaatagttggatgcattgggattataatcgccacactattacgacaacgattgaaaaacgtgatccggctaaaattttgattggcggtgatcttcatttatcaggcaatgatcttgaaaataatgcgtctactctttctgtaggaaaacgcttattactcggtgatgaggtatttataaaaaatgataaaaatgaaacgttacattccacaaccggtacatcgctcaataatattgatattgcaggaacgataaatgttacggacaaaggacattgggatagcttccataaaaagaaacgtcgctatggaataggggtaaggaaacgttgggcggtttatggtaccggaagaggggatttgaatgacattcacccgacgagccatttcttcttcaataaggtagataatactatcggtcagcctgttgacagcaccaacacgcaaattacagctcaagctgaggcgattgtgccaaaccaaatgaatggcgtaattattaacttaccggaacaaagtctatatcagattaaccccgatgcccctaatggttatttagtggaaaccgatccgcactttactaaccgtaaacaatggcttagctccgactatatgtttaacgcattgcgttacaatcacgaaaatgtgcagaaacgattgggagacgggttttatgaacaacgcttgattaatgaacaaattcatcaactcaccggacgacgctttttagataatcaccaaaccgatgatgagcaatacaaagccttaatggatagcggtatttattatgccaaaaaatttaacctgcacctcggtgtcggcttaacagcggagcaaatggcagagttgactgcggatatggtatggtttgtgaataaagaaattacgctaccgagcggtaaaaagttgacagttctcactccacaagtttatcttgttgcacgaaatcttgatgtaacttcacaaggtgctttaatttcagcgagagaaattatggggcatattaacggaaaacttaccaatacgggaacgattgcggggcaaaatctgaccgcactttctgccaagaatatcaacaaccaagggcttgttttgggggattccgtcaatttacttgcaaagcaaaaattagttaacctcggcggtagaattgaagctcttgattcagtgacattagtcggcaaagaaggtgttgacattgcaagtacaacaactcgccgagcttatcaagatgactttggtaataaatttgaccgcactcatgtagataaccttgccggtattcatgtcaaagataaaaacggtaaattaattgttcacagcccaaaagatgtaactattaaaggtgcagaactcaatagtgcaggcggaatacttgttcaagccaaccatattgatattggtacccttaatacaaaaaataaaacggattacaatgcggatatggataattactaccgcttagaacagcatcaagaagtcggttctcaattaaatggaaaaggtaatatcacccttgccggtgaacagggcgttgtgattcgccaaggggaaattcatagcgagaacggtgatgttcatattgcctcaaacggtaatattcgcattgaagaagggcgtaacaaagagcggctttcttctgcctctaaagtgaagcatagtggttttcttcaatccacgacagatatcactaaacacgagcaccattatgatttagctcaagggtcaacccttgatggtaagaatgtggtgttgcaaagcaatgctaacctgacggttcaaggctcaaatattgttgctgaaaatcagctcaatgctcgagcgaaaaacatcgcaattaaggaagcagaaaaccgtgttttcgaacaagatgttgagaaaaccacgaaatcaggcttaatgggttcagggggatttggctttagcattggcgaaaagaaaaccaccacagaaaccaatcaaaccaaatattacgccacaggtagccaagtgggaagcctgaaaggnnnnnnnnnnnnnnnnnnnnnnnnnnnnnaccaacaaaccggcagtaccctctcttcccttgagggcgatgtgattattggtgcgaaaaaagtcgatattttggctgcagatgacagatacgaaagccattataaacagacgatggaacaaaaaggttttacgattgcggtgaatattccggtggtgcaggcggtacaaaatgcccttgcggtagcgaaacaagccgaacaggttggcgacagtaaaaacaaccgaatcaatgcgatggcagcggcgaataccgcatggagtgcgtatcgagcgggacaagggttaatgcaagcgagtcaaagtctcagccaaatggcgaacggcaatatggcacaaggggcgaatgtcagtgtgtccatcacttatggcgaacaaaagaatgtgcagaccacggatatccaaggcaacasggcggcaaacagtgcgataaatgcrggtggaaaagtcaccgttrcygccaccggagcrggcaaggaatcggatattcacrttgtgggktckgaygtatcrggtcaacaaggcaccctcttacaagcagaagatgaaatcaatttacgggcagccaaacaaacgcaccaagagcggagccaaaataaatccgccggytttaatgcrggtgtrgcggtgagttacggctcaaatggtttagcctttggatttaccgcagggggaaattatggcaaaggctatggcaacggcgatgaaaccacttggcgaaatagccatataggcgataaacacagccaaacccacatcatgagcggtggagatactgccattaagggagcccaagtgcgaggcaaaggcgtacaggttcatgcccaaaacctcaacattgaaagcctgcaagataccatgacgtataaaggcaaacaaatgaatgtgaaaggacaggtaacggtgggctatggcttttccgcctccgccaacttcaatcaatcgaaaatcaacgccgattatgcaagtgtgcaagaacaatcggggatttatgcaggagatgaggggtatcaaattaacattgcccaacacactgacctcaaaggcggcttaatcacctccaccgcccaagccgaaaaacagggtaaaaaccaattcagcacaggcacactttcttattcggatattcaaaatcacgctgattataatgggagtgcggttggtgtaggagtacaagcagatattaacggtggctgggatggtcgtcaggttagagatggctcaccggtaagtcgagtgaatcaaggtatcggctttggttatgacaaagacagccaatctagcctaacaaaaagcggcattaatacgcaaaacctcatcattcgtgacgaacaaggacagttggcgaagacgggaaaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtgcggaactcaatagtgcaggcggaatacttgttcaagccaaccgtattgatattggtacccttaatacaaaaaataaaacggattacaatgcggatatggataattactaccgcttagaacagcatcaagaagtcggttctcaattaaatggaaaaggtaatatcacccttgccggtgaacagggcgttgtgattcgccaaggggaaattcatagcgagaacggtgatgttcatattgcctcaaacggtaatattcgcattgaagaagggcgtaacaaagagcggctttcttctgcctctaaagtgaagcatagtggttttcttcaatccacgacagatatcactaaacacgagcaccattatgatttagctcaagggtcaacccttgatggtaagaatgtggtgttgcaaagcaatgctaacctgacggttcaaggctcaaatattgttgctgaaaatcagctcaatgctcgagcgaaaaacatcgcaattaaggaagcagaaaaccgtgttttcgaacaagatgttgagaaaaccacgaaatcaggcttaatgggttcagggggatttggctttagcattggcgaaaagaaaaccaccacagaaaccaatcaaaccaaatattacgccacaggtagccaagcaggtagcctaaaagggaacactaccctacttgcccaagagcattatcaccaacaaggcagtaccctctcttcccttgagggcgatgtgattattggtgcgaaaaaagtcgatattttggctgcagatgacagatacgaaagccattataaacagacgatggaacaaaaaggttttacgattgcggtgaatattccggtggtgcaggcggtacaaaatgcccttgcggtagcgaaacaagccgaacaggttggcgacagtaaaaacaaccgaatcaatgcgatggcagcggcgaataccgcatggagtgcgtatcgagcgggacaagggttaatgcaagcgagtcaaagtctcagccaaatggcgaacggcgatatggcacaaggggcgaatgtcagtgtgtccatcacttatggcgaacaaaagaatgtgcagaccacggatatccaaggcaacacggcggcaaacagtgcgataaatgcrggtggaaaagtcaccgttnccgccaccggagcrggcaaggaatcggatattcacattgtgggttcggatgtatcgggtcaacaaggcaccctcttacaagcagaagatgaaatcaatttacgggcagccaaacaaacgcaccaagagcggagccaaaataaatccgccggytttaatgcrggtgtrgcggtgagttacggctcaaatggtttagcctttggatttaccgcagggggaaattatggcaaaggctatggcaacggcgatgaaaccacttggcgaaatagccatataggcgataaacacagccaaacccacatcatgagcggtggagatactgccattaagggagcccaagtgcgaggcaaaggcgtacaggttcatgcccaaaacctcaacattgaaagcctgcaagataccatgacgtataaaggcaaacaaatgaatgtgaaaggacaggtaacggtgggctatggcttttccgcctccgccaayttcaatcaatcgaaaatcaacgccgattatgcmagygtrcaagaacaatcggggatttatgcagggaatgaggggtatcaaattaacattgcccaacacactgacctcaaaggcggcttaatcacctcgacagaacaagccgaaaaacagggtaaaaaccaattcagcacaggcacactctcctattcggatattcaaaatcacgctgattataaaggcagcagtatcgggttaagtggttcaatggcaataaactttgacacgccgttaggcaaatacggacaagtgcaaagtaataaacaggcggtgaatgacaaaggggaaaaactttacatagatagccaaggcaagcaaaccaccacaagccgagacagtgcaggtaatgcgaatcaagccaaattggcgaaaggcttagattctttaacggggacgacctctttcggattcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagataccatgacgtataaaggcaaacaaatgaatgtgaaaggacaggtaacggtgggctatggcttttccgcctccgccaacttcaatcaatcgaaaatcaacgccgattatgcaagtgtgcaagaacaatcggggatttatgcaggagatgaggggtatcaaattaacattgcccaacacactgacctcaaaggcggcttaatcacctccaccgcccaagccgaaaaacagggtaaaaaccaattcagcacaggcacactttcttattcggatattcaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggacaggtaacggtgggctatggcttttccgcctccgccaatttcaatcaatcgaaaatcaacgccgattatgccagcgtacaagaacaatcggggatttatgcagggaatgaggggtatcaaattaacattgcccaacacactgacctcaaaggcggcttaatcacctcgacagaaaacgcagagacggaaaaccgcaaccaattcagcacagacacattcacctattcggatattcaaaatcacgctgattataaaggcagcagtatcgggttaagtggttcaatggcaataaactttgacacgccgttaggcaaatacggacaagtgcaaagtaataaacaggcggtgaatgacaaaggggaaaaactttacatagatagccaaggcaagcaaaccaccacaagccgagacagtgcaggtaatgcaaaccaagccaaattggcgaaaggtttagattctttaacggggacgacctctttcggattcggctatgacaaagaaagccaatctagcgtaacaaaaagtgggattaatacgcaaaacctcatcattcgtgacgaacaaggacaggttgaaaaaacgggtaaaaccgttgagcaagtgaaagcggaagttaaaacgaacataaccaccgacaatgccgaaagccgttcgggtaagttggaaaataaatttgataaggaaaaagtcttaaaagaacttaatattcaggtaaaagtaacacaggagttcaggaagaatgcattttcgacgatagatgcttatgtactgccaaaacaggctgaattaagggaaaaaataaaagcagcacaaactgaagaggaaaaagatgaactgtataaggaaatttataaattgcaatatcaaaaacgcttgttagaaacgacagtaggtattattgccggtacacctgagattgctattacacaaggaacgctacaacttgcagcgaccaaaatgcgagaagaaacgctaaaaaattcccgcttatttaaaggaattaaggataaaaagacgggacaaatattgagaaatgacagttacagtagtggttattttgatggcgtgaagttaggtggtgtacgaattgatgttgatgtgatttgtaatagcggaatgggggcttgttctaaaaataatgatggttctataacttttaatggaaccaatgattacacacttaaagatgcaatagatcctacacaaaataataaagcaaaaaaattatatggtgaaacaggtggtttccaagcggtagaggggggatggtattttaatggagaacctatttttaaatataaacttggcagtatttcagatttatctgttgaatcttttgcgggtacacacgatatgtcaggcagtcaaatttggggttggtatgacaaattagggaatacagcccctaaaacaccaatgcaagatacgtcatctaaagcaacaactataattgctattcctatatctgcaccttttgccgtagcagatctcatgtctgctgatttttttgaagttttaatgaaaatcggaggtcaataaaatgaaaaaagctgtcttaatatttattttattcctgttggctggttgctcctatcatgatgggtgcttttattctccacaactggttagctgtgttgataaaggggaagtatttccatccatatctcgctatcagaaaccgtatagtttaggaagaactgatagtaatcaacgttggaaagatgtaatttcttgtggtggtaaatatttggattatgatcaaagaagtgttcctttcgagaaacaagaagaattttattattgtatgctgggtaaaggatatatccatctttcccctgcaaaatgtggttatcaaaaccctaaatgggataaaggggtatgtaatttctaatttaaaatgtagatatattacctctgtcaaagatgaaaaagatttaattatgaataaagagagaactatttatgatttaaatagaaataaaagcagcaaataaaggagaaatagcaatgaaagtatttagtattattagtgttgtctttttgattgggtgctcattcggtggattcaaaccacctaaaccatattatcagtggcgttttgaagataaaaattttgaaacatcttatgaatatgctgtttttagaggcaaagaaatgcgatcttgtggaatggatcctgtattaggtgaaagtgttaaacttaaagtcaatttgtgtatggaaaaaaaaggatggtatctaaaacaaggtccggtgtgtgaggaaaaatatgtatggaatgagccagaatgtattaaatggcgggctaaacacagtaaacctgatgcaaaaccatgggaataataatttacaacagactgaaaggcaattatgttcacctatatcaagaagaataagaaagtattggctgaaatcactgcgtatagaagatatttttaggactaatcaaattttacatcaagaatcaagtaaaaatttgattttaaatggtgcccgagggcggacttgaaccgccacagctcgaaagccgagggattttaaatcccttgtgtctaccgatttcaccactcgggcaagtgtcctgactcggttatgtgatggaggcgtgtcccggagtcgaaccgagctacatggatttgcaatccagtgcataaccgctttgctaacacgccgtagcgtaaattggagcgggaaacgaggctcgaactcgcgaccccaaccttggcaaggttgtgctctaccaactgagctattcccgctttttcgctgcaacacattcgctgtcagtggtgcgcattttacttcgttatgaaaaactgtcaacaattcttttgaaaaaatatgttaattgatgaaaaaaaactcaaaacaggtatttaagaatgcaatttatacagaatgtgtttgtttttagtacatcactatcacttatttcatttatctattttaatgatatagaaaatattctttaatcactggaaactttgtgcaacaatgcaatcctattatgtcgcacaataataaaatatagctaaaagtgcggtcttttttcttagattaattaggtgaagttatgacacaacaatatgctctagatacattactggctcaggccggtaatagaacagatgaaagaaccggtgcggtatctacgccgatttttctttccactgcttatggtcatcatggaattggtgaaagtacgggatttgattatacccgcactaaaaatccaacgagaacggtattagaagaaacaattgcaaaattagaaggtggagatcgtggatttgcctgttcttcaggaatggcggctattcaattattgatgaacttatttgcgtcacctgatgaatggattgtttccagcgatgtttatggcggaacttatcgcctattggattttgcacataagaatattcatggtgtcaaacctgtttatgtcaatacagcttcaagtgaagaaattgaaaaggcaatcactgagaatacaaaggcgatttttgttgaaacaccatcgaatccgttaatggaagaatgtgatgtggcagaaattgcgaaaatagctaaaaaatacaatttgctattgattgtagacaatacttttttaactcctgttttatttagaccaatggaacatggtgcagatattgttattcatagtggaacaaaatatattgctggtcataacgacacattagtagggttaattgttgccaaagggcaagagatctgtgaccgcttatattatattcaaaatggtgcaggtcccgtattatcaccttttgattcttggttgaccattcgaggcatgaagacacttgcattgcgaatggaacgtcatcagaaaaatgcacaggaattggcaaactttttaagagaacagccacaagtaaaagatgtgttatatccaaataaaggagggatgctatcttttcgtcttcaaaatgaaaattgggtaaatccttttcttaaagcaatgaagttaattacttttgctgagagtttaggcggtacggaaagtttcattacgtatccggcgacacaaacgcatatggatattcctgaggttgaacgtgttgctcgaggtgtatgcaatcgtttactacggttttctgtaggattggagaatgtagaagatattaaagcggatttattgcaggcattttctcaactaaagtaaccgcactttaatagatcaagatttaataaaagtcgcaacttatcatacgtaagtaatttgtcgtggtttatgttgtgatttttcacttgaaaagcggagatttatctttatactctctaactggaaataataaatcccaaacaataaaaggaagaaaaataaaaatgagtgaagtattacatacaacagatgcgacttttgatactgatgtattaaaatcagatattccagtattattagatttttgggctccttggtgtggtccttgccgtatgattggacctattctagaggaactttcagctgaattaggtgataaggtaaaaattgttaaaattaatattgatgaaaatcaagcgacaccggctcaatttggtgtgcgtagcattccaacattaatattcttcaaagaaggtaaggctgtcgcaactcaggttggtgcattaccaaaaaatcaattagtaaattttatcaaccaaaatagctaatatgtagcttaagcaagacgaactaaaatagcttaaatctcaaaaggatttaagctattttgtctattacacctttaaatcgtatataaaatcataaaacattacctttggtaacggttaaagatttaatatttctttcacaaaaggaatagtcaacttacgttgtgcttgtaatgaggctttatctaataaagttaatgtatcaaataaagatttaatatcacgatctaaacgttttaataaaaaattagctgtatcatcaggtaattcgatccctcgttgatgggcattgcgttttatcacttctactttttgttgttcatttagtggatttagctgataaatttctccccaacttaatcgtgaggcaagatcgggtaaagagatatttaaattcactggagattgattggcacttattaacagtaatgtactcccgctctcttttattctattcattaaatcaaaaatagccaattcccattcatgatttcctattattgcatggaaatcatctaaacaaaccaactcttgctgttctaaattttccaaaacttcaggggaaaaatattgtgctttactcaatggaatataaatcgcattgcgttgcgatgctaaaaaataattggaacacgctttaagcaaatgagttttacctgtactttttcctccaaaaatgtaaaagaaaggttgatataattgaataaaatttttacgtaatgaaccgagtaacaataaattattgtcgctacaaaaattctctaaggtatcatcgtctatttgatgaataggcaaagggagttgttggctcaaaaaataattccatttgatagtaaagttgactcataatacagaaaaaataggaacaggtgaacctattcctattaatcttgtaaattttagtcttctatttgatttttagccgatggtaaaatgagatttagaataatagcgacaacggcacataaactaatccctttcaaggataattctcctaaattgacaaacattccaccaattccaaaagtcataaccacagaaataatacataaattacgtgcttccgtcacatcaactttcccacgaattaatgtactcatcccaacgacggcaatagagccaaaaaccagcatcataattccgcccataacgaaggtggggatcgtagataggaatgctccaactttgccgcaaaatgaaattgcaattgcccatactgctgcccaagtcataatagtcggattaaaatttcgggttagcattactgcacctgttacttctgcataagtggtatttggtggtccgcctaatagtgatgcggcagatgttgcaagaccatcacctaataaagtgcggtgtaaccccggattttttaagaaatctttgccggttacagaactgatagccatgataccgccaacatgttcaactgccggtgcaatcgctattggtagcaaatataagatggcttccagtttaaattccggtgtcgttaaattcggtaaggaaaaccaagatgctttggcaataggactaaaatcgattaatcccataaataaactcaagatataacccaccgcaatgccaaacattatcggtattaatttcatcatacctttggcaaaaacagctacaattaaagtagtcaatagcgtaatcattgacacgagaaccgcatcaccatattcatagttactgcctttgccggtcgccatatctacagccacaggtgccagtcctaatccgataatgataataacgggtccaacaacaaccggaggaaaaattttctgtaaagcccccgctccacgtaatttaaccaacaggcttaaggcaacataaacaagtcctgcacaagcaagaccgcccattgttgccggaattccccatgaggctacaccatattggattggtgcaataaaagcaaaagaagaggctaaaaagatcggcactttcttgccggtacatagttggaaaagcaatgtaccaattccggcggttaataaggcagtatttgcgtccaatcctgtgattaatggaactaataccaatgcaccgaatgcaacgaataacatttgcaagccaataaaagcttgtttgattttgcccgaaatttctacggggatattttgatttgtcatttaagtttcaactctctgtctgaattaactaaaagtgcggtctattttccaatagattacgcggaaaaaagcggcattaattgccgcttggtattttggtcttatttcgtaccaaaaatcttatcacctgcatcacccaaccctgggataatgtagccatgctcatttaaatggctatcaattgatgcagtatataattcaacatcaggatgtacagcctctaaagctttgatcccttcaggtgcagcaactaagactaggactttaatatgctgacaaccttttgcttttaataaattaatagtcgcaatcatagaacccccagtggctaacataggatcaacaacaattgctaagcgttcatctaaatcacttgctaatttttgaaaataaggaactggttctagagtttcttcatcacgatacatacccactacactgatgcgggcacttggaacatgttccaatacgccgtccatcatgcctaatccggcacgaagaataggaacgacagtgacttttttacccttaattcgatcaatttcaacagcaccacaccaaccatcaattatcactttttcagtttctaaatctgatgtggcttcataagtcaacaggcttcccacttcagtggctaattcacggaaatcttttgtagtaatatccgcaactcgcatcaaacctagtttatgttttactagtggatgtttaacttcaacaattttcatcgcatgtttccttattgatcgattatgtaaaaaaaatccaaacggcggaattctaaatgatcttgattaaaattaatagtattgaaagaatgttttaataaaaaactgcaatatgcagctgcagaatatttattttaccttaggcaaactgttgcatgcctagcgtgccgtcatcaatgatttcagatgctatgcctaagatttctgctactttatcaccttctttaaacatcacaaaaccgccagattccattttattccaatgttcatctttggtaagtgggaacgttgtaataattgttactttatctgtttcttttgcatagtcacgaaaatcaataatattatcatcgtctatgcgttgtgcttttccgaaaggtgccttacgagtgagatagtgtaaatttgttgaacagtgggccatcatccactcaccattagataggataaaattaaatgtgcctctctgtgttaattcttgtgtgagtttttgaattgcactaaacatatcttgttcattaggctttttgggaaaacgtttctttagttggctaagcatataacaaaatgctgtttcggaatccgtcgagcctatcggttgaaaaagactttctgtcatatcgggtaatgaatttaagttgccattatgagcaaaaacccaattttctccccaaagttcacgaataaaagggtgagtattttcaatattgacttctccttgtgttgctttacgaatatgtgcaacaacatttaaagattttatgttgtattgtttaatacaatcagcaatgggagaagaatgtccgggacgattgtcgcgaaaaacacgaattccttttccctcaaaaaaggcaattccgaaaccatcggaatgacaattagttaatcctgctcttcgacgaaatccctcaaacgaaaaaacaatatctgttggggtattacaattcattcctaaaagttgacacataatttatttcatttaacccaattttatgtctttttatctacacaatgagtatgaatttaacaaaaatacagattaaaaatcaacatggatcttagatcaattagttacataaaatagctaaaaaaacttaccgcaccaagttttcacaaggtgcggtaagcaaataagaaggtttaatataaaatgataaggattagtaaacaccttgtgctaacattgcatcagctactttaacaaagcctgcaacgtttgcacctacaacatagttaatatttttttgcccttcgacagtaccgtattttttacaatttgcatgaatatccaacataatacggtgtaatttttcgtcaacttcctcagctgtccagtataaacgttgtgagctttgtgccatttccaaaccggaagttgcaacgccaccggcatttgccgccttaccaggtccaaataaaacgcctgcttccaagaatgcgtcggtagcttcaattgttgttggcatattggcaccttctgcaacaagttgaaccccgttggcgatcaattgttgtgcatcggataattccaattcattttgggttgcacaaggtagtgcaatatccgctttcactccccaaggacgagctccctccacgtattgcaaaccaaattgttcagcgtaatctttaacacgaccacgttttacatttttaatatctaaaagtgcggtcaatttttcttgtgtaaagccttcaggatcataaacatagccggagctatcagaacaagtgacaacttttgcccctaactgcaaggctttttcgatagcatattgagcaacgttacctgaaccggaaaccactactgttttccctgcgaaagattgtcctttttcagcaagcatagcttgagcaaaataaaccaaaccataacctgttgcttccggacgaattaaactgccaccaaatgacaaacctcgaccggtaaacacgcaagctgcttggttagataattttttcatatatcctgcaagataacctacttctcgtccacctacaccgatatcacctgccggtacatcggtatctgcaccgacatgacgatataattcagccattaatgcttgacaaaaacgcatgacttccgcatctgacttacccttaggatcaaaatcggaaccacctttacctccccccatcggtaaggtagttaaagcatttttgaaaatttgctcaaagcctaaaaattttaaaatagataaatttacagatggatgaaaacgcattccacctttaaacggtccaatcgcactattgaattgaactcggaatgctcggtttacttgcacttgacctttatcatctgtccaagcgacacgaaattgaaatgcacgttccggctcaactaaacgctccaataaagcttcagagcgatattttggatttttctctaaaaatggccaaatggaagtgaatacttcacgtactgcttgcaaaaattctggttgatgaccgtcacgttgttctacttttgctaaaaaatcttctaacgatacgattgctgacataatttgtttccttcttaattgaaatgttttgtttgcttatttatatagagagcctttatcagcccacgattaatatgcaataaaatatcaaaacattgcaactaaaattattaaaaaaaattaaaaaactatttaaatattaaattttatttaaaataattgtatatattttaaatttattttgattttggttgggttgatagaagtaatatcaaaaagcaggaggaaaaaactaccgcacttatatattctaaattgaagaatttacagcaaaataaaaactggagactatgtttatctttatatgttaagtaaaaaatgtaaatattagtttcattttgaagaaatttattacacactatatgggcaaattattttgcaactatttttactttaggagttattatgaaaaaagcactattaacagcattagtattaggcacgagtttaactgttactggttgttttgataaagacaacaacgtttctcagcaagcagaaagtacaaaagaaagtgtatcaacagcaattgctgaaacaaaagaagctatgtcaaaaaaagtgacggaagttaaagagatggcgactgaaaaagttgaagtagctaaagaagctatgtcagaacaagtaacggaagttaaagagatggcgactgaaaaagtggaagcagctaaagaagctatgtcagaacaagtaacggaagttaaagagatagcagctgannnnnnnnnnnnnnnnaaagaagctatgtcaaaaaaagtgacggaagttaaagagatggcgactgaaaaagttgaagtagctaaagaagctatgtcaraamaagtracggaagttaaagagatggcgactgaaaaagttgaagtagctaaagaagctatgtcagaacaagtaacggaagttaaagagatggcgactgaaaaagtggaagcagctaaagaagctatgtcagaacaagtaacggaagttaaagagatggcgactgagataaaaagtgcagtagaaaaatagtctatattgggttagattttctttaatgattagagctagaatgattgttttctagccttttttctttataaattgagattaagtttgtctttttatccaaatttgttagaatcagtcagaattttggggctgattttggattcgacggaattagcgaagcccaaggtgcacgtcgaggtgcggtaggcctcgtaaataaaccgcaaaacaatagtcgcaaacgacgaacaatacgctttagcagcttaataacctgctcatagccttcactccctagctttcgctcgtaagacggggataaagtggagtcaaatccaaacgagatcgtgttgaagccgccgctttaggatcgaagcattaaattgaataaagctagttttttgatggcgtgtctgtccgcagtcaatttacgaaattaaagattagactaaacgtgtaggactgaaggtagagtaatttcggacgggggttcaactccccccagctccaccatatcattcgaaaagaaaatttctagacattttgaaccgcattgaaaatgccaattttggcgtaactttttgtttttaatctttttagtgaaatttgttaacaacttaattttattaacaaaatttatttggcttttagaaggtttacggcacatcttgttaagatgttaaagaaaaaccgaaagaaaaacatttactaattgatggctaagggttgttctgaaaaactaagtttggcgatgttaaaatttgactaattaactctattagaagctagttatatcataactagcttctcgtttttatctccaaattaaattactttttcttgtaattgtagtttggaatagcggtccagcgttttttgaattctttaacgacttgttttggttgacgattgcgtgagaaaagccctttatggtttccttgtatacggtaaatcataaggtttgtttcaaagtctgcaaaattccatacttgttccccaacaagattagggatgctgtcaaaaacactatggctcatagcataaaaatcacattgaaactcttcggtataaggaatatcccacatagaatgtaagccaggtaaagtatctgcaccatattctgtcataagaattggtttatctgggaatttactttgccattttaacaactcttgacgaagtccagcttctcctttagctaaatcaccatgatctacataccaagcatagtatcgattcaaagaaatgacatctaccaaatccattacttcatcacgctctggcgttgccagtaaaatattgactaaggtaacaggacgtttttgcggatccaattccttataaagagcaactaatggtttgaaataatcatgagcacctgcttcatggctggctggttcatttgctactacccacatgacaactgaagggtgatttttatcacgttttaccaattcttgaatcgcttgttcatgtgcttctcgggttttcatagcagaccaagttccattatctttgggatttaaatcaagagaagcggtaaagttttggaaaagtccaacggctggaatttcatcaattaccaaaactcccatgcgatctgcaagacgcatcatttcttcagaataaggatagtgtgaggttcggaaagagttggcaccaatttctttcaaaaggttcatatccatcaagtttgctgcttcgtttaaacctcgaccattgataaaggtatcttcatgttttccaaaacctttaaaataaacaggtttttgattgacaaagaattgaccatctgccacatgaacactacgtacaccaaatggctcatcataggtatcaacaactttaccatcaacaagtagctcaatatgtgcggtataaagataagcatttaaaacttcccataagcgtacttgttcgagagtgatatgcccgttacttgattgtgcaactacttgacgatcttcatcaagaatagttacttggattgtgtcaactgcctttgatgtttcaacagcaatagaaagttttgccgtctttaagtcatctgaaagctcactgacgatggtaacatctgaaatgtgaattttaggacgtaccattaattttactgggcgatgaattcctgcatagttgaagaagtcaaagttttctttaaccacttttttaatactgccatcttcttgagtctcttcaatgtaattaccaacaggaagtgtggtgtaatctaagatattattggcacagacagagatttttatttgattttcttggtaaagatcctctggaataattacctcaaacggagtgaatccacctttatgagaagcaagttctcgaccgttaacataaattttggcattgtgagttaccgaaccaaagcgtaaaactaactcatcattttccgctaatttgggaatatccacccaacgctcataccaaaaatctccaatataattacgcttatctttgtcaaccaccacgtcattaaaggaagttggtactaccatcacttcttctggtgataaatccttttcgggattatgctctcctagtttaaattgccataaaccactaaggtcatataaacttcttgtttttgttaacgttggatataacatatattttctcctttgtgtttcttaacgtttaatctcgtgggaagtctcatctagcaattgatcaatatctgcttgagaaatcacattaatatcgccttcaatggtgtgtttgaacttgaaacttgccatagcaatggccaaacttttttcaggactttcttttttaagcatgccatgaataattcccgctgtaaaagcgtctccagtaccaacacggtctaacacttgaatgcctgatttgtctgtctgataaagatgaccatcctgatataaatagcctttcaatagatattcattagtatgtcccatttctctttgagtaaaagcaaagcttttcacgctataagttttagctaatttatccaaaatgctttttaataattcttgatcttcgtaaggtcttgttaaacctaattggtcttttaaatctccttgcccatcaccggaaagacttaacggctcaattccaatgcaaacatctgctagagcggcaagaggggacaataattctcttgcctcttggaaagagttccataaacttgctctaaaatttaaatcaaaagagacagtgagtccctctgctttagccttggtcatcaaataatgggttaagctataaaggttatcattcaacgctggagtgatgccagacacatgaaaccagtcagctcctttgaatacagactctaggtcataatcactcagttgagattcccaaaaagcagagtgttttcggtcataagttacccgactggcacgtaaggaaaagcctttctggtaataataaattcctagacgttgccctttttccaaaatgtaatcctgattgatttgacgagaaaaaagaaagtttttcgtcatcctacctaaatcattatccggaatggcagatataagagaaacgttgtgtcctaattgtgccaaggttgaaagaacatttaattctgaaccgccaaattgacattctagactggtggtcagtgttagggtttgatactgtggtggtgataaccgtaacaagatttcacctaaagaaactactgttttcaactaaaacctccatcttgatgggttgtgctaaaagtagtatacacgatattatgttttttagtacaagaaaatgggctacagtaaaaaataagttatatcatcatcgtaacagactgcttatttagaattcttaatatctattagattattagattgttattcgcattgatttgtcgataatcttcaatgcagtgatgttttaaaaaaacaagcatattctctttataagatgtttagaaaaatcttttttgttttttgtcgtgtggagtgacaaaagtgcggtgtcttttggtgtgtccttagaaatactttacaagtgttgattaaataagttcaaagatagccagcaaaagaattattttagaaatgcagtaaaaattatcatttataccatagaaatattaacagaaattagtaatttaaattgagattaacgacagaaaatagtaaagtagcccactattcattcacttacaaaaatagcttttaaggcggaatttatgggaaaaagtgttgttgttttaggtgctcaatggggcgatgaagggaaaggcaaaatcgttgatttattaacagatcgagttaagtatgtggttcgctatcaaggtgggcataatgcggggcatacattgattattaatggtgaaaaaacagttcttagattaattccatcaggtatattacgtgaaaacgtaacctgtctgattggaaatggggttgttctttcaccgacagccttaatgcaagaaatgggggaattagaaagtcgagggattaatgttcgtgaacgtttgttaatttctgaggcttgtccgttaattcttccttaccatgttgcgatggataaggctcgtgagtcagctttaggcaacaaagcaattggtactacaggtcgaggtattggtcctgcttatgaagataaagttgctcgtagaggtttacgtgtcggcgatttatttgataaagaattatttgccgagaaattaaaaaatattctagattactataattttcaattggttcattattacaaagccgaagctgttgattatcaaaagacgttggatgaagtatttgcagtggcagatattattacggctatggttgcagatgtttcgacaattttagatattgctcgtaaaaaaggcgataacattttgtttgaaggggctcaaggcacaatgctggatattgaccaaggcacatatccttatgtaaccagttctaacacaactgctggtggtgtatccactggagcaggttttggtcctcgtcatattgattatgttttaggtattattaaagcctattgtactcgtgttggtgggggaccattcacaacagaattatttgatgaagtgggggcggaaattgcacggaaaggaaatgaatttggtgccgtaaccggtcgtccacgtcgttgcggttggtttgatgctgttgctattaagcgagcaatccaaacgaattctatttccggtttttgtatgaccaagctggacgtattagatggatttcgtgaagtcaaaatttgtgttggctacaaaatgcctaatggtgaaattgctgaatatgcaccgttagcagcaaaagattgggaaggtgtagagccgatttatgaaaccttaccgggttggcaagaaaatacatttggtataacagatgttaatcagttaccggaaaatactcgtaattacattaaacgtattgaggaagttacgggcgtacctatcgcgattctttcgacaggtcctgatcgtgttgaaactatgattttaaacgatccttttgcggtgtaaatcataaataatagagacaaaagtggtttaattcagaaatgaattaagccacttttttatctcaatcaacttcctgaaatcttcattttttccaacaaaatcgaacctgtttgaatattcgatctatattcaatatcgttaccaaccgcaataatatttgcaaacatgtcttttaattgcccggcaatagtgatctccgatacaggatattgaatttcaccattttcaatccaaaatccaaaagctccacgtgaataatcaccggtaataatattaaccccttgccccattaaatcggtaactaataaacctgttcccatttcttgtaaaagtgcggttaaattttgtgaatttggcttaaccagccagttatgaattccacctgcatgtcctgtactttgcatacctaattttcgaccgctataacttgtcagcaaataggtttgtaaaataccttgttcgataatttctaaatttttcgtacgaacaccttcactatcaaaaggtgttgaagcaagtttgccaatcaaatgggggcgttcgctaatatggaaccaatcaggtaatatttttttacccaaatgatcaagtaaaaaactcgagttacgatataaacttccaccgctaatcgctgttgccaaatgtcctatcaggccggttgccacactattcatgaaaataaccggtgcttcttgagttggaatttttctcggttgtaaatgagatagtgcttttttggcagaattttcgccaacccacaccgcactttccaactcttgaatattacgtgcaacagtatattcataatctcgctcaagttgttcgttgctgcttgcaatcacagaacaagataaagaataacgacttgataaatagctttgtaacatgccatggctattaccataaactcgcacaccggtatgcgaattaaatgttgcaccttcactatttacaatgcgtttatcataatctaaagcggctttctctgtttgcaaagccaatgaaacggcatgatcaacatcaatatcaaactcatgataaagtgctaaatcaggggcatcaaatgccattaattccttatcagctaaacctgcacaagcatccggagaagtatatttcgcaatagctaaggcggaatctaccgcattttttattgctgcatgacttaaatccgaagttgaggcatttcctttttggttccccaaataaacagaaatacctaaagcaccatcattattaaattctacattctcaatttcttgtaaacgggttgaaacggataagccactgactttagtgactgcaacttctgctgttgctcctgcttgagtggcaatctcaattgcatagcttacagcctcttgtaatatttgctcttgttgctttaatagtgcggtagagttttgtttagttgtcatcataaacctttttattaagaaaaaattttggctattctagcctattttcaaatttgtcgctaaccacaaataccatgtcatttcggcaaaatatgaagttatgctaaactacgccaaattctacataaggaaaataggaacaaattatggcgaaacgcaaaaaagaagtgtttacttgggaagatgaagaacaagaagaaattatttgggtgagcaaaagtgaaataaaacgtgatgcggaagcattgaaaaaattaggtgaaaaacttgtcaacttgactaaaacaaatttggataaaataccattagacacagggttacgtgatgcggtcgaacttgcacaacgtttgcaaaaagaggctcgtcgccgtcaaattcaatatatcggcaaactattgcgagctattgatccggaaccaatccaagaagcgttagataaaatcgaaaataaacatcagcaacaacaagtaaaattacacaaattggaattattgcgtgatgaattggtaacaaaaggcaacaatgcacttacggaattattaatacagtatcctcatgcagatcgccaatatttacatagtctggttcgttcggcacaaaaagagcgggaacaaaacaaaccgcctaaatcatatcgagaaattttccaatatttgaaagagctgattttggaagattaacatgaaaatccgcatgttaaagtgcattaacgtttatctgctatttttcacatgtaccaaaatccgctataatggcggacatttttgatataacgtacctaataatgtaaaaaaaccaaagaggtttattatgactactccagtagttgctttagtcggtcgcccaaacgtaggtaaatcgactttatttaatcgtctaacacgtactcgtgatgctttagtggctgattttcccggtcttactcgggatcgaaaatatggtcaagcacatttcaatggttatgactttattgtgattgatacgggaggtattgatgggacggaagaaggcgtagaggaaaaaatggcggagcaatccttacttgccattgaagaagccgatattgttttatttcttgtagatgctcgtgccggcttaacttctgcggatgttggtattgctcaatatttgcgtaaacgccaaaataaaactactgtacttgtggcaaataaaaccgatggtattgatgcagattctcattgtgcagagttttatcaactgggcttgggtgaaattgaaaaaattgcagcatcacaaggacgcggtataagtgcattaatggaaaaagttttgccgtctgttgccgacaagctaagtttagctaacgcagaagatcattcagaaagtgcggtagaaaattcagatgaaagtgcggaagaatgggaaaaagattttaattttaatagcgaagaagatatacagctacttgatgaggctcttgtagaagaacaagaagaaagcgaagataaaaatatcaaaattgccattgtgggtcgtccaaatgtaggaaaatcaacactaactaaccgcattttaggtgaagatcgtgtagtggtgtatgacttaccggggaccactcgagacagcatttatattccgatggagcgagatggtcagcaatacactctcattgatacggccggtgtacgcaaacgtggtaaagttcatttaacagtggaaaaattctcagtcatcaaaacattacaagcgattcaagatgcgaatgttattttgttgacgattgatgctcgtcaaggcatatccgatcaggatttatcattattaggttttattttaaataccggtcgttctttagttattgttgtcaataaatgggacggcttagatcaagatataaaagatcaagtcaagtctgaattggatcgtcgtttagactttattgattttgcacgtgttcattttatttctgctctacatggtagtggtgtaggcaatttatttgacagtataaaagaggcttatgcttgtgctacaaaaaaaatgacaacatcattactaacccgcattctacaaatggcaacagatgaacatcaaccgccaatgataggtggacgcagaattaaactaaaatatgcacatccaggcgggtataatccaccaattattgttgtacacggcaatcaaatcgaaggtttgccggacagctacaaacgatatttatctaactattaccgtcgtagcttaaaaattattgggtcaccgattcgtttattgttccaagaaggaaacaacccgttcgcagggcgtcgtaataaactgacaccaaatcagttgcgtaaacgtaaacgtttgatgaaatttatcaaaaaatcaaaacagcgataaatataatataaatgggcggaaaatatccgcccaaaatcactgcactttgcctctatattttttcttattttgcgatctctctcgcaaatatttcccaattcaataaactttcaactttttatcttttatattaaagcctttccacacaaacggatataaggataattatgcgagtattagcactattttttatgttgttcattataaaagttcaagcaacattgccggatttcatgctgttggaaaactataaaaatcaggacgtaagcggttgggtgatgagtgaaaagttggatggcattaggggatattgggatggcaaacaacttttcactcgacaaaataaagtcattcagccaccgcactattttattcgtgatttccctccctttgctattgacggcgaactttttaccgaacgtaatcaattcgaaaaaatatcctctattgtacgttccaaaaaagataaaggttgggaaaaaatgaaattatatgtttttgatgttcccaatgcacaaggaaatttatttgaaagactggctgttttacaagattatcttgataaacatcctacaccttatattcaaattattgagcaaattcccattaaaactaaacaacaagtgaaaaattttttacaacaaattgaaaaacagcaaggtgagggagttgttttacgtaatcctcatgccgcctatgaacgaaaacgcagtacacaaattttgaaattaaagaccgcacttgatgaagaatgtactgttatagctcatcatcaaggtaaaggacaatttgaaaatatgctaggctcaatcagctgtcaaaatcatcgtggcatttttaaaatcggctcaggatttaatttaattgaacgtagaaatccacctccaataggctctattattacctataaatatcgtggattaactaaaaatggacttcctcgatttgccacttattggcgttcaaagaaagaataaaagtgcggtgatgattgatataaaatcttcttatggggctgatattttcctttacaagccgtaaaatctgcctaaaataaagcccccaaatagcttgcatggtcaagctactgacttgtaatcagacttaagagaaaatttatgacaactcaattcaaaccggaattattatctccagccggttcgttaaaaaatatgcgttatgcttttgcttatggtgcagatgccgtatatgccggtcaacctcgatatagtttgcgagttcgcaacaatgaatttaatcatgctaatttaaaaatcggtattgatgaagcacatgcacttggtaaaaaattctatgttgtagtgaatattgcaccacataattctaaattaaaaacctttatcaaagatttacaacccgtgattgatatgcaacctgatgcactaatcatgtcagaccccggcttgattatgttggtgcgtgagcatttcccaaatattgatattcatctttctgtacaagcaaatgcagtgaattgggcgacagtgaaattctggaaacaattgggtttaactcgagtgattctatctcgtgaactctccttggaggaaatcgctgaaattcgccagcaagtaccggatattgaagttgaaatatttgtgcatggtgctttatgtatggcatattcaggacgctgtttattatcaggctacattaacaagcgtgatcccaatcaaggtacttgtaccaatgcctgccgctgggaatattctgttgtagaaggaaaaacagatgaagtaggcaacattgtgaatgttggtgaagaaattcccgttaaaaatgtcgcaccgacgttaggtgaaggaaatacaacaaataaagtctttttattagcggaaaatcagcgacctgaagagcaaatgtcagcctttgaagatgagcatggtacttatattatgaactctaaagatctgcgtgcagtgcaacatgtagaaaaactttcacaaattggtgttcattctttaaaaattgaagggcgtacaaaatctttctattattgtgcaaggacggctcaagtttatcgcaaggctattgatgacgcagcagcaggcagaccttttgatgaaagtttaatggatacattggaaagtttggcacatcgtggctataccgaaggttttttacgccgtcatacgcatgatgaataccaaaattatgattacgggtattctatttctgaacgccaacaatttgtcggcgaatttaccggtaaacgtaatgaacaaggtatggcggaagttgcggttaaaaataaattcttgttaggtgatgaagttgaattaatgacgcccaaaggcaatgtggtttttaccattgagcgtatgcttaatcgtaaaaatgaacacattgatgccgcacttggtgatgggcattttgtttttttagatgttcctcaagatattcaacttgattatgcgttactcatgcgtaatttagttaatgcaaatacaagaaatccgcataataaaaaataatcgtttgttagaaattttttgtgaatgtaaaaaatatttcgccctttcttgatgaaagggcttttttaccctctatttatatcacctaatttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttatttgaaaaacctttaaaaataaccacttttatttgccaaagcaccattagaacatttattaaatcaatctggcgtgattttttgtcaagaaaaaattgcttttgatcacgtaaaaagcggaaccattaatgatagcaattattttgtttattatggcaaagtagcatcattggaacaacattttcaattgcaaggcaaaaattatacttgctacgctttttctaatcctccttacccttttgttagacctgcaatttttgatgatgaactcaattttttagagcaagcactctcaaataaaaacaaaattgataaaaagaaagcttttgtgttttttaaacgttatgccaatcaaccgatttgtgttggaaacttccttcaaaaactatcctatctcctctattttcgttggtgcagtcataacattattgacaactttgattttttctgcactagcatggtttatcagttccattattgtcttctggcagcaacgcaaaattccctctgagtatcgacaaaaaatgcgtaaccgagaaccatttcaacgcttatcgaaaattgtgcctcttgttttttaggtgcgggtatttatggtgcggtcgccgctcacgatattctgccaaaatggaacggatttccacaacctcaaatccaacaactttctacgcagtattgctcagccaattggtgccaaaatctttccaaaatcaacatcaaaacaaggacgctaccagctggagtttatagtgcggaagaaaaaacgcgtattattcaaaaaaccttagtcaaaaaaggttacaaacttaaagtggacggaaaatttggtgcaaaaactcgcaatgccgcagtaagttaccttgcgaccaaaggtatcagcgtcactaacgatatcgccttggatcggttgtttgagtattttgaaccaaacttacagtaaaaaacattattttgaagtactgtatattgatagaatgtttattctaatatatagctttttatatgacttaaactctttttaacgtgcttatttctttgctttaattacagatgttcttgtatattatagtttttcatatctgtgatatttatcacaaaaacgaaataaaaattccaaattttaataaaaatgaaaattttgcattgaaataaaagtagtaatattgtattaatatcaaggtatttaagtggttcaatattacagtctgatcactaaatagagaagttcattgctaaatttaatatttacatatgctaaaattgataggaaaattctatgaaaactgcaaaaaactgcaaaaaactgcaaaaaactgcaaaaaactgcaaaaaactgcaaaaaactgcaaaaaactgcaaaaaactgcaaaaaactgcatagcattcttttaactacgctacttatctcccttcctgtactatcacaagctaaaaccctaagattggctcatcatatggctaatgataatgttaaccatacactagttatagatttttcagacaaactcaaagaaatatctaatggaaaacttactgttgatgtttactcaaacgggattttaggcgatcaagtggagctatttgaaggaatgaagctcggtactgttgatatgtccatctcagatactagcatcattgcatcttattattctccaattgggattttagatatgccttatttttttaaggatatggagcatattaaaaaattactaagtacagccaaaatggcagaaattaaaaaacaagttgaagccaaatcaggggttaaaatattaagtattcaacctgtcgcttatagaaatattattctcaaaaaagaacttgctgataataataaatttgatggcttaaaaattcgagtaccaaattctcctgtacttgttaatactataacgttgcttggagctacaccaagtccaattccatcaggtgaggcatacactgctatccaaacaggcgttgtcgatggcatggaaggtaatccggaatttttaagctccattaaaatcagcgaagtagctaaaaattggtatgagacacaacatgccatgacttttactgcgttaaatattagtgctaaaaaatttaattcattaacagaatctgaacaacaatggattaaagaggctgtaacttttgcaatagatcagttttatattaagactgtcaacactgatgaaaaatggagaaactatctaaaacaacaaggagttgtatttcataatgtagacatatcagttttaagagaaaaagctaaaccaatggttgataaatttgttaaagaaaatgagctagaagaactatatgcagaggcacaaaaatgaaattagaccgttatatttcctcattcagaaatatattaacgattatacttttttcttccctggtcattgttgtatctataggtgtgttttctagatttttaacatcacatccatttgcttggactgaagaattatctagatttatttttatttggctagcgtggatagcttcaagtttaacgattgctaagggagttaatattacatttgatattgtgttagataaattagaacaaactatcggtaatattgctcatattatcgtgaatgttatttctattatttacatactcgtagtcattatattgggatacatactttgtattaataatacaaattcatactcccccttactaggtgttccaatgtggactctaaatcttgcgatacctgttggtggggtattgatggtttatgagcaaattaaaaatttaatcaagaaacgttaattataatgaggtgatatatgctacttcttgcattcttatgcttctttattttggttctgctcggcgtgcctattgcattttcgatgggattaggtgccataatttcaattctgtctaatgatttaccgttagcattgatttctcagcgtttattctcaggtataaattccttttcattattagcaattccgttttttatgttagctggagaattaatggagaatggaggaatatccagaagacttattcatttatcgaaatgtttagtcggacattttagaggcggtctaggtatgatagatatatccacctctgtaatttttgccggagtatcaggatctgcagcagcagatacagccgccgtcggttcaattatgatacctaccatgaaaaaaaatggctatccagcaggcttaactgcagtccttcaatcggtagcaggatctcttggtccaattattccacctagcttaactgcgattatttttgcctcattaactggattatcaattaaagatttatttttagcagggattttacctggaattgctatagctatcggattggttctagtcacctatttctatgctaaaaaatataatcttggtagagatcaaaaggcatctagggccattttatgcaaagcatttaaagaggcgtcttctgcattatttatgccggttatcatagtaggtggaattttggttgggttctttacgccaactgaagctggggctgtagcagtactttatgctattgcagtcggtatttattataaagaattaacttttgaaaaattcaaacattcaatactaaatgcagccgcaatgaccgcaatgtgtaccctaattatatcaggagcaactattttatcatggattatcgccttcactcgtttgcctgatttaattatagggttcttaacaagtattacggataatccttacatgatccttctgctcttagtagcatttttattatttatcggcatgtttattgaaactattgccgcaactattattgttgcaccaattttaatgccagtagcttatcaatatggaatagatccgatacaatttgccataattatgatcgttgtcttagtttacgcaggagtaacccctcctgtcggtggagtattgttcattactatggggattgctaatgtcaaactacaggaaacgctaaaatacctcgttccttatttaggtgtcatattcatcgttgtgttactgatgatattattcccttcgatctctttgatgatacctaatatgttccgttaaaaaacaagtgagtataatgtgtttttcattttactcacttgatggcgataatgacacaatttcctcttgtatgaacccatatttgcgactagactacgcccttacagtttttattatgattttacgaagttatgtatttatctgatttctattttgacttacctgatgaattaattgcacgttatcccaaacgtgagcgttcttccagtcgtatgttgcaattaaacggacaaaacggagaattatttcaccgcacttttagcgatgttgcagatctgattaacgaaggcgatttgctgatttttaataatacccgagtgattccagcgagaatgtttgggcgaaaagcaagtggtggaaaaatagaagtgttggttgagcgagtattaaatgaacatcattttttagcccatattcgatcttcaaaatcaccgaaagaaaatacagtgctttttttaggtgaagataagctgggagaagggaagggtgttgaaatgctgatgaaggcacgccatgaaaatttatttgaactggaattaagtgataaaagtaccgctcttttagatattttacagaaaataggtcatatgcctttacccccttacattgatcgtccagatgaagatgccgataaagaacgctatcagacggtctacaataaagttccgggggctgtggctgcaccaactgccggcttacattttgatgatgagctattgacacaactcaaaaacaagggggttaattttgcctttgttaccttgcatgtcggtgccggcacttttcaacctgttcgtgtagaaaatattgaagatcataaaatgcacgcagaatatgtggaagttccgcaagaagtggttgatgctgttttagccacaaaagcaaagggtaaacgagttattgcagtaggtacaacttctgtacggtcaattgaaagtgcggcactttttgccgaagaaaataatagcactcatttacttgaaccctatttttccgacacttccatttttatttatccgggcaaaaaatttcgtgttattgactgtttgattaccaatttccatttgccggagagtactttgattatgctggtttctgcttttgccggttatcaacatacgatgaatgcttataaaagtgcggtcgaaaatcgctatcgcttttttagctatggcgatgccatgtttattacgaaggcctaaaagccgattacatcagactgtttatctgacgagaaggattacaaatgacaatgaaatttaccttacataaaactaacggtatggcacgtcgaggtaccatgacttttaatcgtccgcagggcgaatttacggtggaaacgccagcttttatgccggttggaacctatggcacggtaaagggcatgacacctgaagaagtgcgggcaacaggggcagaaattttactgggaaatacctttcatttgtggcttcgccccggtcaagaaattatgcgtcaacacggtgatttacacgattttatgcaatggcatcgtccaattttaaccgatagtggtggttttcaagtttttagcttaggtaaattgcgtaaaattactgaagaaggtgttaaatttcaaaatccaattaatggcgaaagaattttcttatcaccggaaaaatctatggaaattcaatatgatttaggttcggacatcgtgatgattttcgatgaatgtacaccttatccggcaactttcgattatgccaaaaaatccatggaaatgtctttacgttgggcaaagcgtagtcgtgaacgttttgatgaattaggtaataaaaatgccttgttcggtattgtacaaggcagtacttttgaagatttacgtaaactttctattgaggggttaattaatatcggttttgacggctatgctgttggtggattagctgttggagaacctaaagaagatatgcacagaattttagcatatgtttgcccgcaacttccggcggataaacctcgttatttaatgggtgtcggtaaaccggaagatttggttgaaggtgttcggcgtggtattgatatgtttgattgcgttatgccaactcgtaatgctcgtaacggtcatctttttgtcagtaacggtattgtaaaaattcgtaatgcaaaatatcgtaatgacacaacctccctcgatcctgaatgtgattgctatacctgtaaacactataccaaagcttatttatatcatctagataagtgcggtgaaattttgggggcgagattaaataccattcataatcttcgctattatcaacgtttaatggctcaaattcgtcaagcgattgaagaagatcgttttgaggattttgttgtagaattttataaaaaaatcggtaaatctgtgcctacacgataagaaagtaataataattgtcggagaaataacctacaaggtcggttattgataaataaagtgcggtgaaataaaaagatattttcacattaaaagaattttatgctattttacgcaagtttttaatgaatgtttaactcacttataaggataaaataatggaagctcaacaaagtagcccactttctatgttatttatttttgccatttttggattgattttctattttatgatctatcgtccacaagcaaaacgtaacaaagcacataagcagttaatgtctgaattagcgaaaggcactgaggtgttaacttcaggtggtattatcggtaaaatcagcaaaatcagtgctgaaaacgattatgtcgttatcgcattaaatgatacaactgaaatcactatcaaacgcgattttatcgtagccgtattgccaaaaggttctttaaaatctatctaaattttcattcattccgcaagggaacaagtctatgttaaatcgttaccctttatggaagaatctaatggtgatcctagtgatcgccattggtgttttatattctcttccaaatctttacggtgaagatccagctgtacaaatctctggaacacgagggcaaaccgctgatataaacgtgcttactaatgtacaaacattattagagcaaaataatttacctatcaaatcaattattttggaaaacggctcaattttagctcgtttcaacaatacagatgatcaacttttagctaaagataaaattattgaacaacttggtaataattattccgttgcacttaaccttgcacccgccacaccaaaatggttaaccaatattggcggtagaccgatgaaatgggggttagacctacggggaggtgttcgtttcttaatggaagtggatatgcacactgcattggataaacgccaagaacaattacaagacagcttacgtaccgaattacgcaaagaaaaatatcaatatacgtctattcgtaatggagaaaattttacaactctcattaccttagctaaaccggaacaactttccgatgtacaacgtttcttgcgtaaacaacatcaaaatctgaacgttaatgccatttctgaaaacacactaagtttagaattatcagagaacgctctaagagaaattcgtgatcatgctattgaacaaaacttaagtattttacgtcgtcgtgtagaagaattgggtgttgctgaacctgttattcagcgtcaaggggctgagcgtattgtagtggaattacccggtgtacaggatacagctcgggcaaaagaaattctaggtgcaacagcaacgctggaattccgtttagtaaatcaaaatgcaaatttagatgtcgctcttagaggtatggtgccttctgattcggaagtgaaatatgatcgcaatggtagtcctattgtgttatatcgacgagctgtattaggcggtgagcatattactaatgcaagttcaggcatagatcaaaataccggttctcctcaggtttcggttactttagattctgaaggtggtgaaattatgtcacaaactaccaaacttaatctaaagaaaccaatggcaactctatatgtagaatataaagacagtggtaaaaaagacgaacatggtaaaactattttagctaaacatgaagaagttattaatgttgcgacaatccaaggtcgtttcggttcacaattccaaattaccggcatcaatagccctgctgaagcacaaaacctatcggtattactacgttcaggtgctttaactgcaccaattcaaattattgaagagagaacggtaggcccatctttgggggctcaaaacgttgaacaagggctgaaagcaggattatggggattagccattacgattatatttattctattttactataaacttttcggtttatttgccggcatagcccttattgctaatatggtacttcttgtaggcataatgtctttattacccggagcgactttaacaatgccgggtatcgcagggattgttttatctgtcggtatgtctgttgatgctaatgtattgatttttgaacgaataaaagaagaaattaataatggtcgcccaatccagcaagctattaatgaaggttatagcggtgcatttacgagtatttttgatgcgaacttaaccactattctaacatcagtcgtattatatgctgtaggtactggaccggttaaagggtttgctattacactctctttaggtgtagcgatttcaatgtttactgccattacaggaactcgttttcttgtaaacttaatctatggcggaaaacgtgttgaaaaattatcaatttaaggcaggtgaatagtgagtttatttacacgcaataaaaaagtgcatgaatataaaggggtcattttaccttttaaactaaccccttttatgaaataccgctactggggatatgctttctctatcattgtaactgcggtctgttttttctttatttttactaaaggattcaactggggactggattttaccggaggaacggtgatcgatacccatttttctcaaccggcagacctcaataaagtacgatctacattaaaagagaatggaatagaaagtgcgttggtacaaactacgggaggtgttcgagatgtcatgatcagattacctgtcgtagaaagtagtgctgaagtgggtaataaaattaaaactatcctcaatagtttggatgaaggtcttgaaattcatagtattgaatttgtaggtccgaatgttggtgaagaattaacacaaggtgcaatttacgcaacattagcaacattactgatgttattaggttatattgctttccgtttcgaatggcgtttaggtacaggtgcagttatcgcccttgctcatgatgttattgtcactttaggtgttttttcctacttccaaattgaaatggatcttaccttcgtggctgctattctgtctgttgtaggatattcgcttaatgatagtatcgttgtttttgaccgagtgcgagaaaatttccgtaaaattcgccgtattgatactgttgaaattattgatatttcattaacccaaactctggcaaggacattaatgacatcaatcacaacattatttgtcgtaattgcactttttgctttcggtggaccaacaatccatagcttttcacttgcgttgttaatagggattgcttttggtacttattcaacgatttatattgcaattactctagctcttgatttagggctaaaacgtgaacatatgctaatccaaattgttgaaaaggaagagtttgaagaaggcttctaaactcatgttgtcgggcatttgcccgacatttagaaccaacaaatcaaaacactggaaactgtttaaaaaaataacaatgaaaaatgagtggtaggatttttcacaacaagagttgtttaacacgagtttttttggtttaaaacgttagtcatgtttttcttatgttattctcatcaaaaacctatctgtatcatcttaaggtcgaataaatcgaataagcaagcatagtaatcggtcaaaaagtgcctactgtcttgctttgaaaaaaaagattgtctttctcaatataacgtattgctatgtatagactctactacacgtttttttggtagacggtatgtattttaggcgtgaaaatttttagaagtatttggaggtaattctaaaatcttagttttggagagcaaacggaaaagacagaattattgaaattttaagtagcgattttggggattaacgaggtaactttttggtgctctgagcgagacttgaactcgcacgtcctacggacactaccccctcaagatagcgtgtctaccaattccaccaccagagcgtaatttgaatttaggtttttattgaggaatgtcgctgttttttgtgtcaggtgtcggtatgctttgttgtttttcctgaacttgctccgcaacttttgataaatcatcaaacttaccacttttaacattattgctatgtgaattgatattaccaatcaataaactgatagcaaaaaatgctgttgccaaaatggctgtcgtacgagataagaaattgcctgcacctgctgaaccaaaaactgttcctgaagcaccaccgccaaacgaagcccctgcattagcacctttaccttgttggattaagatgaagccaatgaggacaatggcaatagctaagtaagcgatcagtaaaacttggtacattatttcttctctctaaattcaaacatttctataaacaaaataacgtgcgaatactatctaatattggaaaccttcgcaagtggttttgataaaaattcggttaattgttttaatttcaggcaaaatttaaactgtgtttactcattttttttcaaatctgcttttttattctctttcgtttgaagtcctagtttccgcattgcggaaaaattaaagtaacctaataattcaggtaaaagttcactgagcgtttgcataaattgttgataggatccttgcctgcggctgatgctgtccagttgagcttcccaatgtgcggtcatatccggctgagttgcgatttctggtaaggctttaatgagtgttctgcctgtttctgtactgtgaatattccgcccttttttatagatgaatcctcgcttaaataataattcaataatgcctgctcttgttgcttccgtacctagaccatctgtttcacgtaagatttttttcaattctttattttgtacaaaacgtgcgattcccgtcattgccgaaagtaaggttgcatcggtaaaaggttttggcggttgtgtttttttgctaattacatcacctttttcacaaaataattcatcaccttttttcacaataggaagcaaaggttcttgttgttcatcttcatcctcttttccccaaagttgtttccagcccgcaatttgtaaatttctcgcttgagcaataaaagttcccccagcaatatctaatgtaattttactttttcgatattcagcctcttgacaaaattgcattaagtattggcgagcaattaaattatatatttgttgttcattttggtttaaatgcactgtttgacgttttgctgttggaataatagcatgatgtgcttctacttttttattgttccaacaacgatttttaagtgcgggattgactatattaggtatttcttgatacagaacgctttgtgtcgaaattgcatttaaaatagtatatctctcggcaaaatgttcttcaggtagatatcgacagtcggaacggggataagtgatcaatttgtgagtttcatataatttttgacaaacatctaaaacctcttgtgcagacatggcataacgtttcgctgcatctatttgtaatgcagaaagtgaataaggcaaaggggcggtttctttttctcttttatcaatatattctgtcaccgtcgctggctgtgcggtaatgcgttttactacatttttagctaaagcgttggataacacccgtccttcttcatcctgataatcttcacaggctttacttggttgccaaagtgcggtaaatgttgagggcgttttttcttttgttgcaataaaggcttgaacctcaaaaaaatctttcggttgaaaatgctcaatttctaaatcacgacgtacaattaatcccaagacaggtgtctgcactcggccaacggatagaacaccgttatagcctgattgacgaccacgaatagtgtaggctcgggtcatattaatgccatataaccaatctgctcttgaacgtgctaatgctgatgtagcaagggggataaaatttttgttaggctgtaatttttttattgctttttctaccgcacttggattgagatcgttaattagacaacgttgaatttcggctaattttgtagcaggcaacttggcataactgaaaacttcatcaactaataattgcccttctcgatctggatccccagcattaattataatgtctgcttgatgaattaatttaagtacaatgtccagctgactttttacttcttgtctgggaagtaatagccatttttgcggaataataggtaaatgttctaaacgccattgtttgaacattggattgtaaacatcaggagcagcttgttccaataaatgtcctacacaccaagttacataatcttgttcgccacatttgacaaagccttgtccacgttgatgcggtttaggcaatacgtcagcaatagctcgagcaaggctgggtttttccgctataaataatcgcattagactactgattctagggattgatgaaagccaaatattctaacataaagtcaggctattccaaattcgctaaattttcgctaaaatgccttgcgttttttgattaacttagatggaagaaaattatgttcggaaaaggtggcttaggtaacttgatgaagcaagctcagcaaatgcaagagcggatgcaaaaaatgcaagaagaaattgcacaattagaagtaacaggcgaagctggagcgggtttaattaaggttacaatcaatggtgctcataactgtcgtcgtattgatattgatccttctttaatggaagacgataaagaaatgttagaagatcttattgcagcggcatttaacgatgcagtacgccgtgcagaagaaatgcaaaaagaaaaaatggcatccgttactgccggtatgtctttacctccgggatttaaaatgccgttttaaattaattcatatatgactgggacgcaatgtttgcgtccgtttttttaataagacaattcattatgcaaagcagtcctcttttagaaaatctgattgaacatttacgttgtttacccggcgttggtcctaaatccgcacagcgtatggcatatcatttattgcaacgtgatcgtagcggtggtatgaatttagctggtgctttaaccgaagcgatgtcgaaaattggtcattgtactcattgccgcacttttacggaagaagagagttgtgcaatttgtaataatccaagacgacaaaattcgggttttctttgtgttgtggaacagccttccgatattccggctattgagcaaacagggcaattttccgggcgatattttgtgttaatgggacatttatctcctttagatgggattggtccgaaagaaatcggtttggatttattgcaaaagcggttacaacatgaaagtttttatgaagttattttggcaaccaatccaactgttgaaggcgaggcaacagcgaattatattgcggaaatgtgttttcaacataatataaaggtcagccgtattgctcatggtatccctataggaggggaattggaaacagttgacggtacaactttaagtcattcacttattgggcgtcgtgaaattcaactataacatggttgacgtcctcccccgactttaggtggggaggatgtcaatccttattttatcgttacacgtgcgaattttcgttttccgacttgataaactgcggtggaaggtgaaacaataagttttgcattgtcgactttttcaccattaattttgaccccaccttgctgcaccatacgaatagcctcagaagttgagccaacaagtccagcatcttttaataaattcgctaaaccgatttcgccggtaaaggtaaattccggcatgtcatcaggtattgcccctttttgaaaacgatcaataaattcttgttctgcagtatctgcatcatcagcactgtgaaagcgtgtaataatttcttttgcaagtaagattttgacatcacgtggattacgaccgttttcaacatccttttttaattgtgtaatttctgtgagcgggcggaatgacaacaggttataccaatcccacataagctcatcggaaattgacatgattttaccaaacatattacttggcgtttcggttacgccaatatagttgccgagagatttagacatctttttctcaccgtccaatccgactaataaaggcatagtaattgcaacttgaggtttttgtccgcaagatttttgtagctcacgccccattaataaattgaaggtttgatctgtaccgcctaactcgacatcggcttctaaatgtacggaatcatgaccttgtaaaaggggataaataaattcatgaatggcaatcggttgattattgttaaatcgttttttaaaatcatcacgttccaacattcttgcaacagtataattcgatgccaaacggatcattcctattgtacccaacttacctaaccaatctgaattgaatacaacttgtgttttttgtggatccaatattttgaaaatttgtgttttataagtttccgcattgcgtaacacatcttctcttgataaagggggacgagtagtattttttcctgaaggatcgcctactgttgcggtaaaatcaccgattagaaagattacttcatgaccaaagttctggaattggcgaagtttattaagtacaaccgtatgccctagatgaatatcgggtgctgttggatctgcacctaatttaatgcgtagcggacggttttctttgagtttttcaatgaaatcctgttctgaaaaaacatgatcaacaccacgtttcaattcggcaattacagtatttatattagtcattatgaatccttaatttgaataatattaataagttttttattttccttattatagggattattgattaaaagaaaagtccatagaatataaggttgtcgtaataattcatttttttcttggcgaccaaagtgcgaataaaaaaagcggtcaaaaagtatttccttttgaccacttatcttctattttaaagactagaatttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttattgcaaatgtttctcattcaaattttcacataaatcaagcgttaactcgttgggcaaggaaatctaatacctgctctttagcaattatttgtttttcacccgtacgacgatttttatattcaatttcgcctttttctaaatttttttcaccaataacaatcatatgaggaacacctatcaattccatatccgcaaacatcactccgggacgctcttttcgatcatcaaagataacatctacatttttattgagtaagctctgatacaattcttcagcaaaaatttgtacattttttgacttatacatattcattgggataattgctacagtgaacggtgcaatttcatcagaagaccaaataattcctttttcatcatggcactgctcaatagtagcagcaacaacacgacttactccgatgccgtagcaacccataatcatcgtttgtgggcgaccatcctcaccttgtacagttgctttcattgcctccgaatattttgtacctaattggaaaatatgcccaacttcaatacctcgcttaatctgtaaagtacctttgccatcaggacttggatcgccttctacaacattacgtaagtctgcaactttaggtagggcaacatcacgatcccagttaacattaaagtaatgtttgccatcaatgttcgcaccagtgctgaaatcgctcatgagtgccacggagcgatcaataaaagccggaattggtagattcacaggccctaacgatcctatactggcaccaatttttgtttttatttcgtcttcatttgcaaattctagaggatcggcgacttccggtaatttttgtgctttgacttcgtttaattcatgatctccacgtacaatcaatgcgataagaggttggtcttcatttgcaccttttacgatcagtgttttaactgttttttccacagataaattaaattgttcaactaagtcattaatagtttttgcatttggtgtatctactaactccatagttgcactcggtgcctggcgttgacctattgctacggcttccgccaattcaatattggctgcgtagtcggaattgcttgaaaaaacaatatcatcctcgccactttttgccagtacttgaaactcatgagatgcactgcctccaatagatcctgtatcagcttgtacggcacgaaaatctaatcctaaacgagtaaaaatattattgtaagttcgatacatgacatcataggtattttgtaaacattctttgctggtatggaaagaataggcatccttcatcaaaaattcacggccacgcattacgccgaaacgaggtcgcacttcatcacggaattttgtttgaatttgatataagttcaatggtaattgtttataagaactgacttcacgatgcaccaaatcggtaataacttcttcgtgagtaggccccaagacgaaatcacggttgccacgatctacaaaacgtagcagttccggaccatattgctcccagcgttgggactcttgccatagctctgccggttgaacaacaggcatttcaacttcaattgcaccgctcttattcatttcctcacgaacaatattttctacttttttcaaaacacgtaagccggttggcaaccagttatataagcctgatgctaaaggtcgtatcatacctgctcgtagcatcaattgatgacttactacttgagcatcatttggggtttcttttaatgttgataataaatatttacttgtacgcatttttgttcctatatttcataatgttgaatgaaaaaattggcgatagtgtatcattgagtactattgaaaaaaaagcaaaagggataagaaagtaacattttttagtcaaggaaataatcatcttccccaacaccaatgtaatttgagaattcatcagggctaaagccatgagaaagcatataacgccagattttttgtttagttttggaatcttgtttatttcgatattgaggaaattttttgttcaaaacctgtaatactattttgcaccaatcaatttcactttcttgtgcaatttcgtcaatcagttctgcttgaatgccttttagttggtgcaattcttgtttaattcgctgtaagccataaccacgttttgcacgatgataaagataattttcagcaaaacgcttatcattttgccagtttttttgttggcaatgggcgagtgtttgtgcaatttcttgctcagtaaaacgtttctcctgcattttgcagcgaagctcaaattcactatattcacgccgagcaagtaaactcatcacgtagcctaatgcgagagaagacatatatttattttcctttgcggttaaatgtagataaagagagtatggacgaaagaaaatgcggtcgttttaccgcactttctatgatgagagctaaatactcagtactaattaaaaatcactttcaacttcagatatgtttgattctgattcagcttcaagatccgctaacagtgctttttccggatttgctaataattctgaacgtaatttttgctctaaaatagcagcttgctcaggatgttcagctaaccatttcatcgcatttgttttcccttgaccaattttttcgccctcataggagaaccaagcaccggatttatttactaacttatgttttacgccaagttcaataagttcaccatttcttgaaataccctcaccgtataaaatttggaaatcaacttgtcggaacggaggtgctactttatttttaaccacttttacacgagtttcattaccaatgacttcatcgccatttttgatactaccaacacgacgaatatcaaggcgaacagaagcatagaattttaaagcattaccacctgtcgtagtttcaggattgccaaaaacgacaccaattttcatgcgaatttggttgataaagacgaccaaacaatttgagtttttgatctgacctgttaatttacgtaatgcttgcgacataagtcttgcctgcaaaccaacatgagtatcacccatttcgccttcaatttctgctttaggcgttaaagcggcaacagagtcaacaataaccacatctacagcaccggaacgaactaaggcatcacagatttccagtgcctgttcaccattgtcaggttgagaaattaataattctttaacatcaacacctaatttagcagcataaatcggatcaagggcgtgttccgcatcaataaatgcacaggttttccccgctttttgtgcttgagcgatgacagataatgttaaagtagttttacctgaagattcaggaccaaaaatttcaacaatacgtcccattggtaagccaccaatacctagagcaacatctaaactaagtgaaccggttgaaattgcttcgatatccagtttttgggtgtctcctaatttcataatcgcacctttaccaaattgtttctcaatttgtcctagtgcggcttcaagtgcttttgctttttcttctggggttgccattttatacctcaagtaaattatgtatcagaatttatgtacaatattatactgtattcacatacagtgcaatttaaaatttgatatttttagaaattttgcgatctaatcagcaaaaagagaaaattattccgtattattaattaaattttctaatgcttcttgcatggaaaaccatgaaacttcaacatcttcaagtgcttttttaagctgaacctgttcatttaaaagtgcggtgagttttgttttattttctgtttgataaagcactgtatcagaaagcagcatttcaatttcttgtagtttttgttggtatatttgcattttgctttcaagagcggtaatttttttgcgtaatggtgcggtccgttgacgtagatctgcctcttttcgcttttgttctttgcgatgattagcggtgttttcgttgctattgatgattttctcattatgtttcggcgtgctattaatttcatttagccatttttgatagtcttctaaatcgcctgtaaattcctcaacttgtttattatgaaccaaataaaattcttctactgtattacgcagtaaatggcgatcgtgggaaaccacgaccagtgaaccttgataatctattaatgcttctgtcaaggcttgacgcatatctaaatccaagtggttcgtcggttcgtccagcagtaataagtttgggcgttgccaaacaataatagctaaaaccaagcgagccttttcaccgccggaaaaagaagaaacagcttgatttactttgtcgccatggaacgcaaaactgcctaagtaatcacgtaattgttgttccgtttgttgaggagcaattttttgtatatgccagagtgcgttttcttccgaacgtagcgtatccaattgatgctgtgcaaaataccctaattgtacgccttttgctaattggatgtggccggaaagtgcggtcaattctcctgccaataatttaattaacgtagatttgcccgcaccatttttaccgagcaacccgatacgagatcctggtactaaattgagcttaattttttgtaaaatttccaccgtactttctccattgtcataacctgcactggctttttcaatggaaaccaaggggttgggtaaagcgagcggttcacgaaatttaaaggtaaaaggattatctacataagcaggtgcaataagttccattcgttctaaggctttgacacgactttgtgcttgtttggctttagttgctttggctttaaagcgatcgatatatttttgtagatggtttattttttgttgctgttggcgataaagtgcggtttgttgtgctaattttgttgcacgttgcacttcaaaggaagaataattgccactgtattcatgcagtttatgttgttcaatatgaatgattttattcacaataggatcaagaaaatcacggtcatgtgaaattaaaatcaaggtaccttgatattgaattaaccaacgttctaaccaaatgacagcatctaagtctaaatggtttgtcggttcgtctaataagagtaaatcagagcgacaaagcagggcttgtgcaaggttaagacgcatacgccaaccgcccgagaaagatttaaccgttcttgttaaatcctcttgagaaaaccccaatccatgtaaaagagaagccgctctcgcttgaattgtccaagcatcaattgtgtctaattgtgcatgaatacgggcaatatcattgccatgattattttcggtagcagttgctaaggccttttgtaatttgcaatattcacgatcgcctttgataacataatctaacgcacttatttctaaggcgggtgtttcttgatttacccaagccattgcccagtgatttggaaaagtcacatcaccttcttccgcactcatttcttttttgagtagtgcaaataaagaagatttaccacaaccgttttttccgactaagccaactttttgaccggggttaatagtggcacaggtattttctaagagtaaggtatttccacgctttaaagttaaatttgtaaaaaggatcattagataaactcactattgattaataccgatatctccactcataaatcggaacataattagaggtgaaacctgatgagttgagcaaaggtgaagatcgtacatataacttgcaacgcttagatcgatcaaccgcaacattgtctttagtctagtcgtaacgatctaaaaacgattatttatattcgagttagtcgttacgatcggaaagatgattggattcgtcaagttcaaattttagaactttacaaaatatccaataattctacttcaaatactaacgtgctgaatggtggaattgaagcaccggcaccacgttcaccgtaagccaaatgatgtggaatagttaatttccattttgaacctaccggcatcatagataatgcttctatccaacctgcaattacgccacttactggaaattcggctggttgcccacgtttgactgaactatcaaatacagtgccatcaattaaagtccctgtataatggacacgaacttgatcttgacgagttggaattgccccactgccttctaccaacacttcatattgcaaaccggtttcagttacttttacgcagtcttttttcgcattttcttcaaggtattttttaccttcttcttcaatttgcttaaattgtgcttgtgcaatttcgctggcttgttgctgtaattcctgtaacgctttagcaacttcgtttaattctaaagcgggcggattttgattcaatgcgtcataaatcccttttgcaacggcttcagctttaaccgctaatttgctatcgactaattgttgaccgatttgtaaaccgataccataactaccttgagctgaaacatcatctaaggcaacctgtgcaaaaaattgttttgtcattgttttccctttattgtcgttgaaaattatttcttataagccaatacttcgcctacacgtacaggcacatcaacttctaaagagcttgccagttctactttatctgcttggaataaattgatcacagttgaacctaattgaaaagctcccatttcctgtcctttacctaatcgcaccgcactttcaccgctataagtccactctttcacttccgtgctgcgtggcggattaattattccagcccaaacagtactcatactggcggtaatagtcgcaccgactaaaatctgtaccatagtgccgaattccgtatcaaaaacacagatcacacgctcattacgagctaataagttaggaatatgttcatttaaaaacggattgaccgaaaataaatcgcccggcacatagatcatcttacgcaaagtagcatcacaaggcatgtgcacacggtgataatcacggggagaaagataaattgtggcaaattcaccattttcaaattctttagccaattcagtatcgccggccagcagatctactaagctaaaactatgtccttttgcctgcaacaaggtttgttgttcaatatgtccacattgactaattcgcccgtccgcaggtaaacaaagtgcggtaggattttcatcaatttttctcgcatcagcttttaacggacgaataaaaaattcattaaaacttgcatagtccttaaattctgttttctccgcctcttgcatatttacatgatactttttggcaaaaagtttaataataaaatgcgttacacttccccatttttgttttgccagccagccagctgccagagttaaataaagttgtggcatgacatattgaaaagcaattttcaaacgttgccaataagtcggttgttttttttcagcattatacataacaggtttccttagaaaaattgaacggggattataacaagttattggcatgatgtaatcagtagaagtgttattgtttgtcgcagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngattatgcagaaagaagcgaatttctagcagtgatcgagcgtttaattaaatggaaactcaaagattaataacatagataagagaatcaattatgcagatcctgttgcaaaaatattacaattatttacgcattgaacgacaactcagtccatatactctcataaattatcagcgtcagctggaaaaaattgtagtgattttacaacaaaacgatattcactcatggcaacaagttacaccaagtgtggttcgttttgtattagcacaaagtcgtaaagaaggcttacatgaaagaagtttagcgttgcgtttatctgctttacgacaatttctaaattatttggttgtacaaggtgaattaaaagttaattcagccgttggtatttctgcacctaagcaaagtaaatatttaccgaaaaatatggatatggaacaggtgcaacaactgctgactaatgagagtaaagaacccatcgatcttcgtgacaaagcgatgatggagttgatgtatagttcggggttgcgtttatccgaattgcaaggtttgaacttaaacagcatcaatattcgtaatcgtgaggtgcgtgtcatcgggaaaggaaataaagagaggattttaccctttggacattatgcttctcatgccattcaaaaatggttgagagtgcggttgttatttaatccgaaagatgaggcgttgtttgtcagtcaattaggcaatcgtatttctcatcgttccattcaaaaacgtatggaaacttggggtattcgacaaggcttaaacggtcatctcaatcctcataaattacgccattcttttgctacccatatgctggaaaacagctcggatcttcgtgcagtacaagagctattgggacacagtaatttatccacaactcagatttatacccacttggattttcaacacttagcacaggtttacgacaaagcacaccctcgagcaaaacgtaaaaagtagctggaagcaggcaaaattagacgaaatactaccgcacttgatggacgttcaaacgcaacttggcaactcaccttgttcaataataatgccgacgttattagcttgtgctatcgctttaggtttacttaattttatttttacccaagaaatattaaattttactcttaattgctctgcaacttcgtaagctactcgctcaattaacaaaaatgggcgagattgaacataattcaatataaactcactcacttccgcataatttaagcaatattttacatcatctgtttgtgcggctcggcgacaatcccacgccatttcaatatcaaaaatgagcttttgcttgatttgctgttcccaatcataaacaccaatttgagcaagtgcggtcaatccttcaataaatattttgtctgtcattataactccgatgaacgaaattccattaggcttatactatcaagtttatgtacaatagacgaacgaaaattttccgtttcggcgattgggagttgatgatgagtttgtttgcgattatttatatgctgttcacttatttgttagggtcaatttcgagtgatgttgtgatttgtcggtttaccgagcgaaacgatgctcgtgtaacaaactcaaatgtattacaaaaaggggggtatcggcttgttttggcagtttttctatgtgatgtcttaaagggtatgttgccagtttgggtaggctattatttagggttaacttactttgaattaggcatggtagcactcgccgcttgtttaggtcatatttttcctattttctttaaatttagtgggggaaaaggggtggcgaccgcatttggtgctatcgcccccatcgcttggggtgtcgccggctcaatgcttggtacttggcttttaatctttctctttagtggctatgttgcattaagtacggtcgtaactgcattaatattgcctttctatgtatggtggtttaaaccagaatttacttttcccgttgcattagtttgttgtttgttagtttatcgtcatcatgaaaatatccaacgtttatggcgaggacaagaagataaaatttggtctaaatttaaaaagtaacgttacatttgcttgcttaaaaatttaaatagaaatctttggttaaggttttaaattctgtactgtattgattgttccgatcataaataaccaactgactttcctcacatttccgttcttctcggctaaaactaagtaataaacgctgtggagttttacctgctttagtgatgattttacattctctaatacaaaaaagaccgcactttttttgtaaactttttccttcttcaaatggcaaaatcaagtgaatttcacccgttaggtttaatagtttttcggcggcgtttagccaatccaagtggctttgtgttagggtatagcgagctagattgcgttgtttactggcacaatcaataccttgcttaaaataaggaggattcgccgtaatgacatcaaatttatgctcacaatcttgtgcaaaaacaataatatcttgttgaaaaatcttgattttatttgcccaagggctttgttggatattgtcttttgcttgcaaataagcctgcggatccaattcaactgcactaatttgacaatgttcagggctacgttgagccaacatcaacgcaatgagtcctgtacctgtacctaaatcaagcaacgtatttgcttgatttatatttgcccatgcacccagtaaaatcccatcagtccccactttcattgcacattgatcttgattaatgtgaaattgtttaaacgtaaactcttgcttttttgccataaatatcctgaaaaatgaccgcactttaagaacaaagtgcggtataatttgccacaaattttttttgaataccaattctttaatgtggataaatatgacatcaacgcaatttgaagacttcgatcttgcccctcaattactaaaagcccttgcccaaaaaggctattctcgacccacagtcattcaacttgatgctattcctgccatcatggaagcgagagatgttttaggttctgcaccgacaggtacaggaaaaacggcagcttttttgttacccgctcttcagcatttgttagattatccacgtcgtaaacctggccctcctcgaattttagttcttacgccaacacgtgagctggctatgcaagttgctgaacaagcggaagagttggctcaatttactcatttaagtattgcgacgattactggtggtgtggcttatcaaaatcatggtgaagtgtttaataaaaaccaagatattgttgttgctacaccaggacgcttactgcaatatattaaagaagaaaactttgattgtagagccgttgaaatactcatttttgacgaggcggatcgtatgttgcaaatggggtttggtcaatatgcagaaaaaattgcagcagaaactcgttggcgtcggcaaacattgttgttttccgctacgcttgaaggtgagttattaatggattttgcctctcgtttactgaaagatccggtgcaatttaatgcagagccaagtcgtcgtgaacgtaaaaaaattaatcaatggtattatcatgcagacagcaatgaacataaaattaaactccttgcacgttttattgaaaatgaacaagtcagtcgtggcattgtatttgttcgtcgccgtgaaagcgtgcgtgaattgtccgaaactttacgcaaacgtggtattcgcagcacttacttagaaggtgaaatggcacaaactcagcgtactaaggctattgataaactgaaaaatgatgtggttactgtgttagttgctaccgatgttgcagctcgtggcattgatattgatgatgtcagtcatgtcatgaattttgatttgccttataacgccgatacttatttgcatcgtgtcggacgtaccgcaagagcaggcaaaaaaggtaccgcagtatcttttgttgaagcacatgactataaattattaggtaaaataaaacgttatacaggagagttgctaaaacctcgaattatagaaggattagagccaagaactaatcctcccaaagatggtgagataaaaacagtgagtaaaaagcaaaagaatcgagctaaaactaagttggaagaaaataaaaaagcggcacggaagaaaaaacaaaaacttcgccataaagacataaaaaacattggtaaacgtcgcaagccaagcgaaaaaatcgctgaataaagcggtaatatatcccctgcctttaaggggattatgttagtgatactttaaaggtataatcttcaattcactttcatcaacaggcaatctaaaccgttggttttcttctaattggttactcataacgacttgcaaatataaaataccgttaagattgaccgcacttaaaatacatcctgttttacgccaagcatgttctaattgcatttcaatttcagtaccaatttctacaagtgcggcagttttggcttgcaataaatacatggcacgtttatttatccctcgatatttggctcgagctatagtttcttgtccaatataacaacctttttggaaagaaatagcttgttcgatttcttgtaaattcagtgcttgtggaataaattctccttgtccgattattgttaaaattggaaagccttgctgcatatccaagtaatcccaatattgtgtatcttgcgtatattcaaggctcattttttgttcccaacataaaatctggcgattacccaaatcaatgcgaatttgtggtgaaatagcaccgcactctttcagatcctgatcaagcatgcccacaatagtccaatttttttcactaaaagtcacttgagaaaaaaccgcatatttttttaattgagctaagccatgattgagtaaatcttggcggattaagagataaaattgttgttctgcatgacgaatcagacgaaaaagagaattgactttacctttcggatcgcaatgtgcggttaatgtggattgaccgattgccaactttgttacatcacaggttaattgtccttgtaaaaatttttcggcatcaacgccttctacataaattaaaccatattgcttaagattaattaacatttttgtccttattcaagattttggatttgttcacgcatttgttcaattaagacctttaattcaaccgctgatgaggtaatatcggcgttaatagatttagacgcaagcgtattactttcacgattaagttcttgcatcataaaatcaagtttacgcccgacagcaccacctttgtgcaaaatagcgtgtgtttcttttacatgtaattgcaaccgatccagctcttcagctatatcaatacgttgtgccaatagcaccatttcttgttcaatacgttgtgtatctgcttgtaattgaatttcatcaaaacgttgttgcaaacgatctcgttgccattgcaatatttccggcataaaagaccgcactttttgtgcctcaacggaaattgccataaggcgttgttcaattaatttttgaactttttctccctcacgagctcgtgttgcaataaactccacaagcaaatcatcaaaggcttgcaacaaatcttcgatgatactgtccaagtcctgttccggcgtttccactacaccggggtagcgtaaaatatccatcagattgatttcaccctctccggcttgtgcttttatatattgcaaagattgaataacctgtttggtgaacttttgattaagatttaagttgagtgcggtttgttttttagtgtcaatacgcaagctacattcgattttacctcgagccagtttttgccgtaatttttcacgcaaagtattctccaatcctcgaaattgctctggtaaacgaaaaaaggtttctaaataacgttgattgaccgagcgaatttcccatacggcatccccccattcttttttaatttcaacacgagcaaaggcagtcatactgtaaatcatatttttatatcctcacttttatattaatttaccggtgctattgtactgttaaatttcttttatgtcagtttgcatgataaaattgcaaaaattttttaacttcattcaaaggaatatgtcatgcgtccaaatgcgagagcaatcaatcaaccccgtccaataaaaattactcgtcattacactaaacatgctgaaggttcggtattagttgaattcggtgaaaccaaagtgatttgtacagcgacggttgaagatagtgtaccacgttttttaaaagggcaaggaaaaggttgggttactgcagaatatggtatgcttccacgctcaacccatagccgtatgcaacgtgaagcggctaagggtaaacaaggcggtagaacgatggaaattcaacgtttaattgcacgctcattacgtgctatggtagatttggaagctttaggtgagcgtgcaatcacattggactgcgatgttattcaagcggacggaggtacgagaacagcatcaatcacgggggcttgtgtagctttaattgatgcaattaattttttgctgaaaaacggtacgttgacaactaatccgataaagggattagttgccgccatttccgttggtattgtcaacggtgaaacggtgtgtgatttagaatatgtggaagatagcattgccgaaacagatatgaatgtggtgatgatggaagatggccgtatgattgaagtacaaggaacagcagagggtgaaccgtttagccatgcagaacttcttaccctattagatttagccaaacaaggttgtgaacaactttttgtggcacaacgtgttgcattagcggaataaagatagtttgtgcaagataaaaaatctacaatatacatttttacaatgtaagaatatcgcaatgaaaatggtgtggaaatacaggggttaaaatgaattttctcggaaaaataatcggttttatttttggttggcgttttggtggtttttttggtgctgttgtcggcctaattctaggacaccttgccgataagaaactgtatgaattaggaagtgtaaattccagcttttttaaaaataaactcactcgtcaatcgctctttatgcaaactacttttgccgtattaggacatttgaccaaagcaaagggtagggtgaccgaagatgatattgcccttgcaacaagcctaatgcagcaattaaatctggatgatgcaggcagacgtttagcacaagaagcatttaatcgtggtaagcaaactgattttcctctccgtcaagttattcgagagtttcgtttaggttgtggacaacgtgcggatttgttgcgtatctttttgagtattcaagtcaaagctgcttttatggataatgaattgcaaggtgcggaaaaaagtgtcttacaaattgtagcagaagagctagggttatctcgtttccaatttgagcaaatacttgcgatggaattagctgctcgacactttagtcgtggcggtttttatcaacaaagtcgtacttaccaacagggaagttatcatcaatatcaagagcaaggacaatatcaaaacagctatcatcaatcaggcccaacgttagatgatgcttacaaagtgcttggtgtatcaggaaatgataatcaacaaactgtaaaacgtgcttatcgtcgtttaatgaatgaaaatcatcctgataagttggtttctaaaggattacctcctgaaatgttggaaatggcaaaagaaaaagcccaacaaattcaagcggcgtatgatttaatttgtaaatcgaagggttggaaataacttaatgcgagtttttttagcacctatgcaaggtgtgcttgatccttttgtacgtcaactattaacagaggttaatcaatatgatctctgtatttctgaatttgttagagtagttgatcagcgtcttcccaacaaagttttttatcgtttatgccctgaacttcaccatcagggctttactttgtctggtacgcctgttcgtgtacaacttttggggcaatatccgcaatggcttgctgaaaatgcccaaagagccgttgaattaggttctcagggcatagatttgaattgtggttgtccgtcgaaagctgtcaatggaagtaatggaggtgcttcattgttgaaacaaccggaactcatttaccaagcaacaaaagctattcgtcaagctgttccaatggaacagcctgttagcgtaaaagtgcggttgggttgggataatgttgatcaggtttttgaaattgctgatgcggtacagcaaggcggagcaacggaaataacgattcatggacgaactaaaagcgatggttatcgtgctgatcggattaattggtataaaattgctgaagtcagaaaaaaattacgaattccagttattgccaatggtgaaatttggcattggcaagatgggcaaaattgtttagccattactggttgccaagatttaatgattggacgaggggctttaaatattcctaatttaagttatgtaataaaattcaatgcggaaaaattagattggcaacaaggtgttatgccgatgttgcataaatatgctcatgttgaaaatgaatttgacaaagggttctatcatattgcaagaattaaacaatggctacaatacctgaaaaaagagtatcctcaagctggcacactttttgagcgaattaaaagctgtcaaagtgcggcggaattacggcataaaatacaataaaaatggcgtgtaatttacgttacacgccatttttcaaccaatgtatttattttacacgagaaacatattcacctgaacgggtatcaactttaatcacttcgccaatttgtacaaatagaggtactttcactaccgcacctgtacttaatgttgccggtttgcctccagttcccgctgtatcaccttttaagccaggatcggtttcaacaacttccaactcaacgaaattaggcggtgtaatcgttataggtgcaccattccataaggttacaatacaatctgcttgatccagcaaccatttttccgcatcacctaccgctttggcatcagcagagtattgttcaaaggtttcaggatgcataaaataccaaaacgcttcatctttataggagtaagtcaggtttaagtccattacatctgccgcttcaactgatgtaccagatttaaagttgacatccaatactttgcctgaaattaatttacggatacgggtgcgagtgaacgcttgccctttacccggtttaacaaattcattttcaataataacgcaaggctcaccgtcctgcataaattttagacctggtttaaaatcactggtagtatatgtagccatatcatcctcaaattaaaagagattgtttttaacaaatgcgtattctaacccaaaatagcataaatagagaagaagaaaattggactgattacctcgcaaaggcaatttccgatcctatagaattacttaattatttagagttaccgattgaatcgtttcagtatgacattgcggcacgtcaattatttccattgcgtgttcctttcccatttgttaaaaaaatggaaaaaggtaacccaaatgatccgctctttttacaagtgatggcttcacagcatgaatttttgccgatggcaggatttaccaaagatcctttggaagaacaacataacagtgttcccaatattttgcataaataccataaccggttgttattaatagtaaaaaacagttgtgccgtcaactgtcgttattgtttccgccgtcatttcccttatgcggaaaataaaggaaataaacaaagttgggtaaaatcgctggattatattgccgcacatgctgaaattgaagaagttattttttcggggggagatcctttgatggctaaagatcatgagttagcatggttaataaaagagcttgaaaatataccgcacttacataccttgcgtattcatactcgcttgccggtagttattccgcaacgcattactgatgaactttgtcggatattgagtgaaagtcgttttcaaaaagtcattgttactcatattaatcaccccaatgaaattgatgaaatattagcctgtgcaatgaaaaaattaaaacatgcgaatgtaaccttacttaatcaatctgtggtgttaaaaaatatcaacgataatgcacacattttaaaaaaattaagtgataaattattcagtatcggcattcttccgtattatttacatttattagataaagttgagggagcaagtcatttttatcttgatgatgaaagtgcggccgctatttataaagaattacaacgcattagttcgggctatctcgtaccgaaacttgctcgtgaaattgctcatgagctgaataaaacgttgtattcggcataggaaaaagaatgaagatcctttaaaatacataaaattttaccgcactttatgtgcttctttaaacataactttctgactcatcaagggactatcatgacagctgaacaaaataaaatcgacacttctggacaagcttctatacaaaaagaattggagcttgatctggatcctatggagccgatacttccgaaaaaaaatcttgcatctaaacaaactttattggaaaaagccaaacgtatttttaagagagcggataagcaaaatagagttgataaagcagaagtgagtacacataaagaagtaatatccgctagtgatgatgaacaacctccaataatcacggaaacacaagagcaacaaataagccaagcaatagacccgactatatctgaagtgcctgttaagacacaaaaagaactgaaaaaaccggaaaattggactatgttaggtgtgttaccgcctaaatatcgccgtatttttattgcattattagttgtcgtcattattttattaattatttcttggttaaaaccggatgataatatagagcaatattttgaacaatcaacaggcaatagtattccgacacaatttcagcctttagatcattctcaaccggttgaaccgagcattttagagcaactgaagaatcctcaaccaaaaagtgaaaatatcacacagaatgatcaggaaaaaaatatgcctgtacaagcgttgcaggtagaaaacgaaccccaaaatatagccataccgataaattcaacacctagtaaggcggacagtccagtagtggaaacaagcaagcgaccaagtattaaagttgaggaagcaacatctcaacctatagcaccaatggaagaagtgaaaattgttgagaaaaacgagccaaataaaaaggcagaaaaacaggtgaaagcagagcagaaaggcgtgcctgttgttgatgcgaaaccggctaatgtgaataaagtaacaaattcacagaaaaccgctctacaaaaaaatgcacagactaaaacccttgttattccgcaaggaacatcactgatgcaagtattccgcaacaacaatttgaatattgccgatgtcaatgcaatgacgaaagcaaggggggccggtaatacattaagtagtttcaaagcgggtgataaagtacaagtatccttaaataagcaagggcgtgtcaatgaattgcgtctatccaatggtgcgaggttcatccgccaagccgatggaagttatcaatttaaaaaataatgatattaagcaaaacggcgtaattttcgcttacgccgtttgattgtcgaactaaaattttttctatttacaaccgctctttttctccaccgaattcacttagcaagttttccgttaatttggcaagaatgccggtcattaaaacaaagtctgcatcaaatcgttgtgcaaaatcttcttttgaaatatcgtcattttgttcacgaatttgatcggcaaattttaagcgttttaaactggcatcttcgttgagagtaaaacttaaatgttcttcccagttgagggataagtttgtgatatatttgccggaatttaacaatccgatcatttcttcactgtccaacacttgttgtttgcaacgaataacggcttgatcttggcttccttttaattccgcctcttccaatacagtcaaccattgaggtgagttttccttgacccaatttgtcatcaccaaacttggctcattagcaaatgcaagtggcacaacaggtaaagatcctaacgattttcttaataaagccaaacagtcttccgctcgtttagttgaggcggtatcaatgtaaataaggttattttccgtatcaatccacaacgcagtatgttggtttttactgaatgcacgaggcaataacgtagcgacaatatcatcttttaacgcttgtttttcgatttttttcagtttgcggttttttttttgctcaagttgttcaatccgttcttccagctcacgtttaatcacttgtgcaggcaaaatcttttcttctttgtgagcaactaacaagagttgttttccaacacaaaaatagagagattcactttcacgcaaaggattgctccaaccgaaccggctcatgtctgattgctggcagggagaatatgcacattgttgtaactgtgattgtaaattttctaccgaccaatcaagagatttagttaaacggtaaattaaggcatttttaaaccaaaacattgttcttcctcaaggtttttcatgtaaaataagcactattgtaacttattcgagatgaaaatatgcaacataaattgattagctttattggcggaggaaatatggcacaagccattgttttgggattattaaaacaaggctatcctgcacattacattcgtgtttgtgatccgaaccaatctcgccgtgatttatttattgcgcaaggtacgcaagtaagtagcaacaatgtcgaggcaatacaggatgcggatgtagttttacttgccgtgaaaccacaaattatggcggaagtttgtgtaccgttaagtgcggttgatttttcagataagttagtgatttccattgcggcggggatttctaccgtaagattgaccgcacttttacccagtgcgaaaagtattattcgtgttatgccaaatacgcctgcacttgtttcagcaggtatggcaggtttatttgcgacaccgcaggtttcggtaaacttaaaacagtttgcacaagatttattaagtgcgatgggggaaatttgttggcttgaacaagagcaggagatgcacgccgttactgccggttcaggaagtagtcccgcttatttctttttatttatggaagccatgcaacaggcattaattgaaatgaatttagatccgaaaactgcccgcttattagtgcaacaatcagcattaggtgcagcgaaaatggtgatcgaaaatccacaaatcgctttatcgaagctaagggaaaatgttacttcaaaagggggaacaacagcgtccgccttagcggtatttaatgaacaaaatgtgacgcaaataatcaaacaggcaatgctggcttgtgttaaacgttcacaagaaatggagagtttattttaaatgagagtttcaccattcagctggattgcaatttgtttgtttggctatttttttgcttacggcgtgtttgttccctattttcccgtgtggttaaaatcacagtcctataatgaaaccacaattgggttaattttagccggagcttacttttttcgtgcattaggcggaatttgggtttcctctttggttaaacgtccctcacaacttattagtggcttgcgttatttagcttgggcaacttgtgtcttgatgtttgtcgccggttttatggcaccgcacttttggctactttgtattttaatcggactgttttcgatggcaagttccggaggattgccattaatggacacgctttctaccacttggcaacagcaacaaggtttagattacggtaaagcacgtatgatcggttctattgcctttgctgccggtgtggtgattttcggctatgtgatagaaatgattaatgcgacaaatattgtatggatgttgaccgcacttttattcgtttatgcaatagggcaaatggcaattccaacttatccgccactcgatcatattgaatctacacaacaagaaaataatgaaacggaaaaaacggattttagcttcatacaattattaaaaaacaaagttacactacgtttgcttattgcgatttcgcttattcatggttctcatgctgcctattattcttacagcgttttatattggcaagaagaacttcatattccgcttcaagttattggggggctttgggcattaagtatcgtggcggaaattgtcctcttcttcttttcatcaaaatggtttcgacattggaaagtcagcacattattttatctttctgcgttaggtgcagtggtgcgttggggcggtttaagttttgccgacaatttgggtattgttatctttatccaacttttacatagtatcacttttgcgaccagtcattatgccattatccgctatatttccacacaacctcatcaagcgatggctaaattacagggcttatataacagtttttccgcctgtattgcagtcggtttattagcgggactttccagtcttatttatccaatctcaccgttttatacattcttaactatgatgttgattgcggcactggcgatccctattattccgagaaatatcaatgcctttcgtcaaagtatcatcactcgagtgaaatcatgaaagacaacgcattaattgatctttttttaaatgaactttggttagaaaaaggattatccgagaataccgtgcaatcttatcgcttggatctgaccgcactttcgcaatggctggagcctcaggggttgagtttagaaacccttgatgtggtagatttacaaacattcttaggcgagcgtttgacacaaggttataaagcaacaagtactgctagaatgttaagtgcattacgcaaactttttcaatatttgtatcgagaaaaataccgtactgatgatccaagtgcggtattaagttcgcctaaattaccgagccgtttacccaaatatctgacggaacaacaagtaacggacttacttaacacacccaatacagaaattccgttggaattaagagataaggcaatgttggaaatgttgtatgcaaccggattacgtgtaacggaattggtgagtttaagtcttgatagtatcaatatcaatcagggtgttgtgcgagttatcgggaaagggaagaaagaacgtattgtgccgatgggagaggaagcaaactattggcttcgtcaatttatcctatatggtagatcctttctcttggcagggcagagttccgatgttgtttttccaagccgtcggggaactcaaatgacacgccaaacgttttggcatcgggtaaaatattatgcaatattggctgaaattgatacttctgcactttctccccacgtcttacgtcatgcttttgctacgcatttagttaatcatggtgccgatttgcgtgtggtacaaatgttactgggacatagcgatttgtccactacacaaatttatacacatgtggctaaagagcggttaaaaattttacacgaacgatttcatccaagaggataaatttttttatatttttttgtacgcctgtatcgtataatgctccgttagtttaaaaagacaaagttaaactatttaaaaaattcatttctttgatacataaggagtttttatgaaatacaaactatctttagcaattctgtcaatactgcccgcactttcccatgcgggggggggtaatttcaacttttacggcaaagcaggaatcgatttaacctctcgttttgaaacaatggttctcagaacagaacaaaataattacgtcccgagtattcctgcaagttcaagacaaaataccttctcgccaagtatcttttttgaaactacctacaatattttaccgcaaacagaaatcggtttgggactgggctatatcaaacgcaaaggcttcgatcattctgccagttggcattttgagaaggatatgcaaaaaaaaacgtgggcacaaacatcagctttcacagacatcgaacaatatagaatttaccgttattcttccctaccaatttatctcatcttgaaacagaattatgcgtttaatgcaaacagcaaattttatctaaaagggaatataggttattcaatcaataaaatgcctaatacaaagtatgctcattattcaaatgagwcaagcctaaagattcagaaaacacaaattggcgatcctatttataaaatgaaagcaaaaaacgggctgtatttagggttgggtatcgggattgaatataaatctttcttagcggaaattggttattaccatacccatgcaactatcagttacaaaaacaaaaatacccaatatccacaatattcctacaacaacgatgccatacgtttaacccttggggtgaaattctagaaaatgaaaagcgactaactgcggttagttagtcgcttttatagaaaatttttatatttttttgtacacctgtatcgtataatgctccgttagtttaaaaagacaaagttaaactattttaaaaaatttatttctttgatacataaggagtttttatgaaatacaaactatctttagtgcttttgtcaatattgcccgcactttcccatgcgggggggggtaatttcaacttttacggcaaagcgggaatcgatttaacctctcgttttgaaaccatgcaactcagaacatatctgaacaataacgtaccgagcattccagccagctcaagacaaaataccttttcactaagtctcttttttgaaaccacttacactattttaccgcaaacggaaatcggtctaggattaggctatatcaaacgaaaaggcttcgatcattctgccagttggcatgtacatactgatggagaatgggcraytagcggggacaatactgctgttgagtactataaaataaatcgctattcttccctgccgatttattttacgctaaaacaaaattatgcctttaatgcaaacagcaaattttatctaaaaggggatataggttattcaattaataaaattgctgacaccaaatataagaaatacacaaatattacaaataaatttgagttactaagtgaaaatctacgtaaaatgaaagcaagaaacgggctttatttaggtttagccattggacttgaatataaatcgttcttagcagaaatcgggtattatcatacccacgctgcggttaattataaaactaaaccttacaaaagcaaagcagaaggctactatgcttggcattcttacaacaacgatgctatacgtttaacccttgggtttaaattctaaaaaataaaaacgtgattaattgatctgcacctaaaagttggactaaacaaccaacgattagtgtgcagatttttatgacaaaagataacccatctttcaaatagcaaatcatcgttgagttttatttatcaaaaaagcagtgatcgctcactgcttttttacggtcgttcaactaggttaccaagcccagccgatacccacaccgccgccgaagtcgccgacagagttactatttccgtgtaatttcaacagaaccttaccgttatcactcacacgagaatagcctaaagcgaccgcactttgacctttatacgtaccggcagagactgaaagcactgatttacccggaatcgaaatcgtaggcaatgccgccgccgcattcgaaccggcaattcctgctcgagattctttactaaacgcatcaaacctattttcaagctggttgaattttttgtcagtatgtgtttgtaaggcatcgacatatcctttgttaaccacggcattcggtgaagagttcggcgttaaatccggcactctgatttctcctttcgccccgtcaatctcaatgcgttgaccttgcgggttggtcaaggttaatccgcttggcgtcaaagtcgcactgtgcttaccgtcagtcaatctcacgccgtctaccccatattgtgccgattggccgtctttatgagttacccgtaatccgttgccgtcaagacgagatttattcccttctacagtttctttggtttcaaaagacgtcatgtttttcaacttatcggacagtttgacttccagtcccgtctcggaggcgtccactttaatattgcysgcmgcsgtkgtygcactgttaaactcsccctcgcctttgatgrtcaatttctcgcctaaatttttatggacaggcacgccgtcrttgccctcaaaatttaagcccgcttgwcctaargctttcamrtcttgcagattggcagcacgcttcacatcaacgctggaatcacctgacaacaacttattgactgcgtcatcttttgtggctaatgcggtttgatacgctttttgcttctcttttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaacatatcgcccactttcgccgtcaccgccttagcctcagttttcactgcttcgcccgcatttttcacgttttcagcttgctcttttgctttatcggcatcaatacccaaaccgctagccacgttgcnnnnnnnnnnnnnnnnnnnngtcggctcggctttgatcacgactttttttgcttcatcggcagaaagttcttgatcaggttttccgtctttnnnnnnnnnnnnnnnnnnnnnnnnnnctttaactactttttggccatttaagtaaaaatcaaatgggcggttgctattcagagcttccacttgcttatccacatagtttttattagtagccatatcgccagtagatttatcgtctaaatcttttaaacctgtgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatccacatattttttattgacggcgtcataatcttgctctggatcgcctacaaatactattcttcttctatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatacaaaagaataatgaccttctactttattttctttacctacagatattgaactaagacctaatacatcagaatcttgtcctattgatattgcaccttgattttttgcgaatgaattatagcccaatgctatcgaaccctcattttgcgannnnnnnntatgtcctatagaaattgaccctgttcctattgcttgtgtttttgcagaatcagaaagtttaacggatttatcccctgtgcctttcagatagtcgactaaggctttggcttgtactaattcgcttgtaccctctgtttcatcttctttaagattgattttatcaatgccgatattagaaccaaaaatcgctttatctttaacatttgcaccatctatttctaaataatactcttctaaatcccctactagagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcacccttaacagtaaaattcgcggcgacattggctaatcttttatctaaatatgctttattgacagcatagttatcataagcatcttttttagggttagctgacgtatcatcaggaataccattttcaataaatacatttttaaaagtaggtttatcttttatacctattaataattgcttactatcttttagatatgctgtttttatattatycggagcatagccatcttcttgagtagtagttggtttatctatagctcccgctttaatgattaatttatcacctaaataatgcgttccttgttcagtatcgccatctccactgccaaaaataaagcccttattaattttatctatatttgcctctattgccgctttaaatgttttttcttcttttagtatctgtccattttgttcagttccatttttaaatttattaaattgtgattttttaaatgtaaatttaccgttatcaacttccgcacctaatacatttgttgcaaagttctttaattgtaaaaagttaacagcatgattgtcattcgttggtgcttcagtaattgttacactcttaaattcaggatcgtcttttaagccgatagtgaattnnnnnnnnnnnnnnnnnnnnnnnnnnnnnnnaaatttcgtttctaaatttttaccgacatattttgttttactgtttgatgaaatatcgccatttacaatttcaatcgtcgatcctaaataaaacggtgtgtctttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccgtaatcgcctgatcggaagtcgctgaaatttcgccatcagccaaatgtccaaattttattgtttcccctatgtcagcagttgtttttccatcagcaagtgtttgcgtttgttcattaaatcctttagcaccaacgaagactttgctcttgtcaatgtcgcctaatttttttaaaggttcgccatttcttgtatctactctataaaatttaccgtcatctgatgctttcgttaatttaattattttgttatcgctttcaattgtataataaacaaccaacccctcttttttgacatattctaatgtttttagctgaccaacagtcgccacatcagaatccaacgctcccggtgcaacatttattattcttctaagtcccactgcctctgtgtttgtaccttcgctaaccttccaaccaccaacagatatcaccccataagaggcatcattttttatttcgtaagttgaacccgcagctttataagcatctaatttagaagctggttctcccgataatttaggcgtaaatttgtcgcttgcatctgcatttttatcataaaaataattagttgttgatttatatcctaatgcaacagaattagacaaattggcttcagcttcattacctaatgccaacgcacttgtagcttctttacctacacctgcttctataccaagtgcgatacctttttccgcttgagattgygmyttataaccgatagmaacygaatatykttkacctgaatacgtattattccctaaygcaattgaggcttgaccaatggcacgygtaaaacttcctattgcaaaggmatctttyycttttgcaaatgaaaatctyccrattgcaatcgcactatcttctttggcgtaagcrtatckyccaatygttagcgtattgtctccyaatgcsaccgaatacgawcckatsgctatwscwccttgattatatccgagtgaatctcttgattgtttcgcttttaattcttccgttccctcttgtttggtcgttttaggtttaattaaacgagaataagtttgtatatctgctgtatttcctttttcatataattcttcaaaatcaaattttgtaccatatgaatttttcttatccgttaaagtaaagccattattattttgaagtccatcattattgaaattatcatccatctctatatttgctaatgcataatttccaattgccaatgaacctctaccgcccgcatacgaatcggaaccgtataccatagcaccatcattaattgcttgtacgttagtacctaccccaactgttctatctgcatatacatacgatttgtttccaagaactaatgattctttaccaaatgcgattgtatctgaaccaattgctgttgaataatctttaaaggcaatggcaaaggttccgattgcagtcgtataatcaccgtatgcaacacttcttgccccaactgctattgaatttttccccctagcccatgtgtgagtttttctattatcgtatttaactccatttaattttttttctttctctattttgtttccaccgtccttatctaaatatttttcataggcgacatttactttagaatcatattcttgttttcgtagataatcgtctttcttttttattttttcaatttcacctctttctgtaactttatcatatgaatgaccattgtttttataaaaaacctcttcaccattatcatttttgataagataataactactccatgttctaccatcgtctcttacaaaataatctccatttaatactagagcactaccatctcttcctactaactcccctttgccattaacatattcattttttccagcatcatcaatacctaataaaaatctaaaatcaactgccggatattcatctgtatagttaaagttttgtgcattatttagaaacaatctaaagatgtcttttggtagttttttttgttttgtatctgcatttccgataccgtctgatccaatcgcaattgaagaatctccccaagcaactgtatcattccctaatgatgtcgcccctgctcctctcgcaaaagttctatatccaaccgctgttccttgtgcattagcattatcaatatttttacctttagtgttttctccgacaatcgctttatgtcctattgaggttgcaccaattccaccacccacagcacgagaacctataatgactgcatatttggcgtgttgattttcaatactagattcagcacctgctttatttgatttgtctgctaataatattagttcttgatgttggtctttaatatttctatttgctccatcataccaaacacttgtattgtagttagatttacctctttcgctggatgtattattatctatccacacatctgccccatacgctacactcgacacccccgacatcgccaacgccaacggcaggaccttaaacgcycctaacaywccgccgaaaaacacaccgcacttcggcttactctccgaactgctcgctatttggcgattryttgccaactckgaaacggctttacattgacctgttgtaatatcatatttggttttgaagattttgttcatatatctattctctttaaaaatggatttttaaattaatgatttctttcgttgattgattgtttagtaaactttgtaggaattggttataaacctaaacaggaaatgccttgttttttaaggcacagcagaaaaaggcgaatgatatcttcgctaagggttttaaaagagtagattggggtatgacgagaagttaaaaactttttaaaatttattttgcaaggtttataaaaaggcgttagcctaggctgtaggctgtaggctgtaggctgtaggctgtcatttttctattctattgttgtttgtcaagtaaaaatttggattattctatctcaaaatttttatggaaaaaacaaatttcttacttttttattctaattcagagggtgatttttaattacgttgtttgatgtcaaagcgaaatttaatgaaaatgaccgcacttttgggcacaacaaaaatccctattggatctgatttcaatagggattggctgtttttaaattatggtaggaatactattttttccaattatattcaggattgataatatcttctatttcatgccaataagcagttagtacgacattgccataagcataagcccgaagtgcatagggcggataaacaaagtttattccttcattattgaagtaaaattgttctgaaatgttgaaatcttcttttgtgatcataccaatatagtcatcattcgcttcttccatcagattggtataaaagttccaaagcacttcttttagcttgctttgttggtcttgcttaacgatgtcgtttagttcaagtattttctttttatgactgtcaatattctgaaatagggttacatttatgccgtgagcaccgccggtataagtatcaatatcgttactgaacgtaatgatattattgcgttgccctagataatttgacgttagatggaatgatgcacctaatacacggtcttcttttgcactttgaacgaattcatcatgaatttgttgaaatttttgtacaagatcttgttttgtcggcgtgtcttttttcatgctatcttcaccgcccactaaggtataagcatgtttgaccaataactgatcaagccattttataccggtttcggataactcaccacgaacttcaatttgtgcattgtcagtagtatattcatcggaatgcgggtaatttacggtttttacttgatcaaagataacgtttttcttgacttgtaaagtcggaacgtcttgttccagacaagctgccaatagaacagttgtcataagagagaagaataaaaagatttttttcatatgattgccaaagtttagtggagtaagaaagtctttattataagttggcagagtatgaatgtaaatttttcttttgggtaagaataaatcgatatattaagtcgctattcttccgtataatatgggttttatttagatagaacgcaaggatattttatgaagcaaactactcaatcgatgaatatagtcgatatattgatcgttacagtgatcttttttggtatgccgatttatacttctctgtcgcaatttttcttattgcaagaaggtgcggtcgcaattacagacacgttgacatttacggatcaggataatatttgggcaattttgatagaacttatctcattagcgattgctgcggtgtatttaaagctaagacgctttgattttacgcagcttaccttttcttttaacgctaaagcgattgtgctgaccgcagggataattttgattgccggcagtctcagcgaactttatttctatttggcagctccctttcaagatgccggtgcatatctcacctcggctgaggttgcacctacagatacaacatcgaccttatctttttacctcgtcctcttttcattgctcaacggtttttttgaagaagtcttttttctcggcttgatatttgcagtgaataaaaaagccttgccttatgcgattgtgttcagcttagtcatccgttttttgtttcatacctatcaaggtatgttttatgcagtaaacgtattgttattcggtatcgtgttgctaatacttcgctctaaaatcaaaaatttattaccgtttacgttagcacatgcgttctttgatgtgtttggattggggttgttacccattattgatattgtcgaaaaaattatcaaataaaaaggcgtattaaatacgcctaaataaacaatcggataaccgttagaaacggtagttaagatttaaaccgtataaattggcacgtgccgttgattgataatccgcacttatattaacgagtttaatctcttttccaatattttgtgtttctctaaattgctgttttttacctcgtaaatgagcaaaacctacgtcaacagaaagatttggcgtgaagttataggttgcccccaagctataccaagtgcggtcggtatcggggattgaggcacttgggtggtcggctgactcatcataagcaatacctgcacgcaaggttaatttatcatttacatcgtaagttgcccctaaggctatacgtgaactgtcatgaaatttttcatctttatggaaagcgaccttgccgttatcataagtggcatgtaaactttgtaaacggctccatttagtatatttatagctgtagtgcatggcgaatttttccgttaattggtggaaaccggaaatttcgaaataatccggcaaatgtagcgttaacccacctttctctttaacaggactaatttttcctggtttaagttgataactcaacgcatcatcatctttaaaattaatatctactttagaatgataggcaataccgatacggttaccttgattaaattcatagactgccccgatattccaaccaaatccccatgcattattatcttgtaattgtattatgctagtatccgaattaacttttatttgagctaatgcagcaagcagttgttgtgatgacggatccaatctgattataaaaccccctgcttgtcctcctggtgttgatatttgcttaacagtaccaagtgcttctttcaaaatacctgcatgacgctcaattttcgctttggcataaaccgcattcaacccagcaccgatgcttaatcctttgctgatacggtatgaaccgcttaaatttaagttaatggaattcagtgcggtggttccacccaaaacaccggcatcataatcctttttatatttactttgtaacccaaagttcacattcatacctgcaccgacagcaaatttatcattaataggtgcgacgaagtacatattgggaataactgcacttggcacaatgtttttctgatccccttttccagtttcaattctctgaaataaccccgcattaacattaacctcaccatttatattaattctagattgaacgtataccccccccattgagaattgtttcgttttaaacaaactcattaacgccgggttggttgccacaactgcggcattatcagcaattgccgcttcacccgcataagctcgtcctaaaccagaactggacacctcagcaatttggaacgccgctgcattaacgtaacttgccgataatgccaatgctgaagcaatgaaagatttagtaaaaagtgattgtttattgctattcattttttatttaatacctctatatatggtgaagttaaattttccgaattctaatgtaagagtagtattgggacaaatgaatttacggatttgttaagtggtcataccaggcggaaatctttcatttactaaagtttataagaagaatttagctgtggcagacaataaatcagtgagttctagttcctcattttgtagaatgttaaaaactttttattgtgttttttgggggaagttataaaggttgagtaaaaaattgtataattcgttataaataacgcaatataatgatttaatgttaaggaaataggaatgacattgtacaaaatattggtgaatagcatcgctatgatttgttttagcgtttcccttgtagcacaagcaaaaataacggtttttgccgctgcttctatggcaaatgtgttagaagaaattaaatctgaatacatcaaagtaaatcctcagcaggaaattgatttttcctttgcttcttcttctgtcttagcacggcaaattagtcagggagcacctgcacagttgtttatttctgcggatcaaaaatggatggattttttagcggaaaagggggcaattgtgacagaaagtcgtcgtgatttggttggtaacagattggtgatgattgcacctcaaaatagtttgattacctctgttgatttgcctaacgctcaatggcattctcatttgaataatacttatcttgcagtaggtgatcctgctcatgtaccggcgggaaaatatgcaaaagcggcatttatctttttggggcaatggaatgatttagaaactaaattagctcgtgcaaataatgtgcgtgcagctttagcattagttgaaagaggggaaagtccgttgggtgtggtttatgcaacagatgcggcggcaagtaaaaaggtcaaaacagtggcgatttttcctgaaaatacgcaccctgcgattgaatatcctatcgctattgtgaacgggcaagataatgaagaaagccgcaagtttttggcttatttgcggtcagaaagtgcggtcaaaatttttcaacaattcggtttttcagtgaaataatttttatgttagatgtgataatcgattatctacgtttatctcaatctgaaatcaatgcaatctctttgagtgttagagtggcgttggtttcaatttcggtgagcttaccttttgctattgctgtcgcatggttgcttgcacgcaaagatttttggggtaagtcgattattaacggtcttattcatttaccgcttgttttacctcccgttgtaattgggtatttattattaattgctatggggcgtaacggtattattggtcgctatttactacagtggtttgattttagttttggctttagttggtacggtgcggcgttagcttctggaatcgttgcatttccgttgcaggttcgtgctattcgtttggcaattgaaaatattgattttcggctggaacaggcggcacaaacgttaggtgcttcttcattgcggatattttttactattacgttaccgctttcattaccggggattttatcaggaatgattttgggttttgcacgatctttaggtgaattcggtgcaaccattacttttgtatctaatattcctcaagtgacccaaactattccgctggcgatgttttcttttattgaaacaccgggtgcggaatattcggcatttagactttgtgttatcgccattattattgcattgatctctttgtcaatttctgaatggctggcgaaacgaatgcaacaaaaattggggtaaagatacttgtaattataagcctgtgccgagtgatactttagcggtaatttttgattatttattttacaatcgttcatcatttcctgtatgaggctttatcgtgtcgttatttctatgtgctgaagaaagattagtgcaatgtgcaacttctttaattgaacagtttcctgagcaatacaacactacactttttcaacaaattcaaaaagataaacataatcaaaaaacgcaactcgggcaattaggttatggattatatttatcagattttgtgtttgaaactttgcaaaaacaaccgcactttctcaaacaatgttggcatcaactccctactttagctgattgcgatcgatatttcgttcgcttacaggaaatactgataaataccgaaacggaagaacaattttatcgcaaattacgtctgtttcgtcatcgtgagatggcaaaacttagcctttgtcaaagtttaaatttagccacagtagaagaaatttttattcggctttctcaattagctgaaagtttgatcattgctacaagagattggctgtatgaaaaaatttgcacagaattggggacgccaacggatacacaaggcaatcctcaacaattatatattttgggtatgggtaaattgggtggatgtgagttgaatttttcttcagatgttgatttgattttcacttatccgacaaatcagggggaaacacggggaggacggcgtagtattgaaaatggtgtatttttcacaagattgggacaacgcttaattcgtgctttagatgaatatactgttgacggttttgtatatagaacagatatgcgtttacgcccttttggtgaaagcggtgcattggtgttaagttttaatgcgatggagcaatattatcaagatcaaggtcgagattgggaacgctatgctatgataaaagctcggattttgggagcaaatatgcaagatccgaatgtaaaaatattacagcaattattacgctcttttgtttatcgccgctatattgattttagtgtgattcaatctttacgtgatatgaaaaataaaattgccggtgaggttcgccgtcgaggattgttggacaatataaaattgggtgctggcggtattcgagaaattgaatttattgtgcaggtttttcagcttattcgtggcggacgtgaaatcattttacaacaaccatcgctgcttcatcttttacctgcactggaaaaattgggtttaattgataccgagcaaagcacaaatttatatcatgcctatttatttttacgcagagtggaaaatattttacaagctattgatgataaacaaacgcaaacgttgccaagtgcggatatcgatcgtgaacgtttacttcttgctacaaaaaattttacctattttccgatatcgacggaaaatgcgggaaaagaaaccgcacttgctcaatatcctattgcaaattggcagcaatttttacaggtattgcatgaacatcagcaaaaagtgcggttcgtttttcgaaatttaattggcgaagatgacgatgaggaagaaaaaaatattgctgatgatctgtggcacgactttctcaatgcggacattaatgagcaagaaattaaagtcatattgcaggaaaatcaaatagatgagcaatattttgatgaaattattgaaaaattgacacagtttaaactggatttatctcgtcgatcagtgggagaacgtggtcgcagagtattaacgcaattaatgccaatgttgttccgtcaagtatttcgatacaaaaattctcagcaacttttacctagagtcttgaaaattctggataaaattatcacgcgtactacttatcttgaattattggtagaaaatccacaagccttaactcagcttcttaaattatgtgcacaatcaaaaatgattgctgaacaagttgcaaaatatcccattttacttgatgaattattagatcctaatgcactgttaaatcctacggattttaatcaatattcatctgaattacgccgctatttacttcgtttaccggcagacgatgaagaacaaattattaatgggttacgccaatttaaacaaaccgccttattacgtgttgcggcagcggatattttaggggcattacctgttatgaacgttagtgatcaccttacctatttagccgaagcaattatcgaaaatgttgtcaacctcgcttggcaacaagtcagtctaagatttggtacacctgaatatttgaaggaaaatcaaaaagggtttttagttattggttacggtaaattgggcggcattgagcttggttataaatcagacttggatcttgtttttctctatgacggaagtcaaacaggacaaactatcggcggtaaaaaatccattgatagcaatcagttttatctgaaattggtacaaaaaataattagtatttttagtatgaataccagtgcaggaatactttacgacatagatattcgtttacgtcctgccggtgatgcagggttattggggtgttccttaaatgcctttgaaaattaccaactgaatgaagcgtggacttgggaaaaacaggctttagttcgttgtagggcggtatacggcgatattgatttatgtgaacgctttgaaaaaattcgttgtaatgtgctttcagctccaagaaatgtggaacagctgaagcaagatatacgagagatgcgtcaaaaaatgtatcatcatctctctaaacataaaacggacgaatttaatattaagactgatttgggcggaattaccgatattgagtttattgcacaatatttggttttagcttatgctccccaacattcagcattaacacgttggtctgataatgtcaggatatttgactgtatggctgaaagtgcggtgatttcacaagaagtttccacaaagctaaaaaaatgctatgtaaatttacgaaaccaaattcatcatttaaatttattaggtcaagaaccgattattaatgcacaactatttagcaaggaaagaacctttattctcaatacatggaaaagtttattggaatgaatgaacttataattgccctaaaatcagcatatgataagaaattatttatcatttgtattttctttgttatgctatgcagacctttaacttacattaacaaatgagaaataaacgatgaaattaaataaatcacttttggtcggcacattagtcgcctcaactgtattattagcagcttgtaatgaaaaaaataaagcggaaacaacgccaactgaaccggttacagttgcagaaactcaagctcaacctgacgttcaaggaaaaactgaaacaacytcrwctgaaycaaccgcarytgraaayacacaayctgawkctcaagaaaaagttgtttcagaaaaaagtgagacagttgaacaagaaattcttaatcagtttaacaatacagttacgatccaattggtggggtatcagagtgaaaaaatagagggtgaagatactttatctttcgtttataacgttaagaataaaggtgataaagcaatcaaagaacttcagtggtataaccttgttttctttaattcgactctggtagagcctctttcaatagcctattcttttgaggatacgcttgctccggaaggcgagggcgaaataaaattaacaaaattagctaaaacttatgctgaagagattcgtgcagatatactaaaaccggaagctaatcttcaatttagcccaataattgcaggtcgaattatttttgaagacggtacgcaattagttgtaactacagatgaagagcttactcaatctttacagcaaattttaacgcaataatttttaaaaataattattcaatgtgctagttatctatccgctcttacaatctataatatttataaataactacaaaaagttatcaataaggttttatagattggtaagagcggttatgtttccgcattgaaatctactgcccattattggcgaaaccgaaagaaattcgtcgtaaaaagcgtgcagagcaacaagaaaaagaagtgtgaagaaaaaaagctgagaatttgctaaaaatcagctcaacaaaccgcactttaataataaaaatttctgcgagaaatcatgtaaaaaaaataacaccctcttaacaagaagagggtgaataatcaatttaccattggtaccctatagaaactgaacctgccattttgccttgagaatttctatttccttgaaatttaagcataatcttaccgttatcactcatacgagaataaccaatcgccattgcgttttctccgccataacctgctgcagaaatggctaacatagatttacccggcatagagactgatgtcaaccctgccgccgcatttgcccccgcaattcctgcacgtaaatttcggtcagtattattcaattgtgtacgcaattcattatttctaccgtccacatagtttttatttaccaccgcacttccagtggttgttggttggatatctggtacggtaataatacctttttcaccatcgatcttaatttcaccacctacacctttaacagttaagccttttgcaccataggtagcagtagcagtaccaatcttatctgttacagttaagctatcgctatttaacgtcgatttcttaccgctctcatctttggtttcaaaggctttcatatttttcaaagtatcggacagttttatttctaaaccatcattagttttattagtttctaccttgatattgccagcggcactactaaacgaacttgtagtttgaccgttttgagtttcctcttcccctttaataattaaggtatcgctcagttttctatgaacagtcttatccttaccactctcattcccagcaaaactcaaccctgcttgtgcaaccgcttttaaatcagcgagattggcggctttgtgtagttcatcttttgtcatttgttgcccttgctgaccgttcataccctcagcaactaattttttcactagctcaagcgttttatcttgtcccattggttgatcttgagtgccattatcaagccctaaaccggatttgaggttattgatggcaacaggtgggtgagaagtactaccatttgtgtcttttccgcctaaagtgatagtatttttcgcttcactatcatatttcactgccactttatccgcttctgcctgtttatcggcgatggtttggattttgtttttcacaaattttttcaccgcaccggcagtcgtgagttttttgtcttcagtatcagcatcctctttaatatcttcagtcgcttcaatcttaaaggaaatggtgcctgtattcgcatcaatactcggtttgatatagtcatcaccttttaacttaattgtcgcaccaagttgacgtgtcattttgtttgctgtggtactaccagcctgatctgtagacgttgtagtactactattgtccacttcaaaaattaaacctttgttaatggtttcgatgtttttatcaatagcttctttgaaagtagctgcggcattgacagtatcgtcttttccgtctttatctttcaatttagcaaaagttggtgctttaaacgtttttgtcttgtcatcaacatcagcccctaaaatatccgtccctaaattaccgaatacacggataacttccgcaagctgtccgccattaatcgcatcagttgaatcaggcattactttacctgcggcaacatgggtaataatgcgttctgcacctgtatcgcccacactgacgaccgaattaaaytkaccatytttagacgtwcctgcmwytttccargtraayatyaaactatttttaccyacattaatgtcagyasttkyaaatrcgtttttsktyktttccmatttngaatttttccccaaggcgaaagaaycatcatcgtccttgtcgctaagttgaataattcccaatttatctgttactttttttgccaatttaagcgtaacgttttgtttgccctgttcaactttcgtttcaatctcatcttttgtgcctaatacttgcaaggcttgcgatctgagtttaacctcagcttgtgcttttccgcttgtagatggcgtacctgtgggctgtggtggttgcggttgaggttgtgcttgtgccgtgttggaattatccgcttcaatttttagcgttaatgaatccaattgagtttttaagtaatttttaaccgcactcaccgttactaatttattgccgttttggtcggttgtactgcctgaaccccccatgccttgaccattcgtatcaattgaattagccacattaagtttaaaggtgattttgcctccattgctaccgccactgccattttcagtcgccaacgtgaggtatgagtcgcctttaaacgttaaggtttcgcccagtttacgaatgaaaggattgtttccgttctgtgttgatggttgagttgtacttccatcttccaccgcaaacttcaagcctttttctacaagggctttggcgatgtcggacaagtctttcacattgacagcgttgttggaaatgttactgccattactaccaagatttccttcgaggacattttcaatattgctatttccgctacttccgccattgctatttacccctaaaccacttccaagtttagtgatttgtttattacctaaatctaagccgtctttgccaaaggtaaatgtgccagtgccagcggtgattttgaccgttggactagttgggctaccactaccattcgtaaattcaattttcgctaccgcacttccgttacttccgctaatcgtgctaatacctttcaaatccttattcaaagcgatttctaatgtgtctttgcttgtttttgtgaaaatattttgatgggtatttgttgcaccattttgcaccgcacttgtcgctgggcttgaagcatcgccttttgctcctgtaatcgtcaaggtcgagccgaggtagagttgttgctcgctatcgcttccaccacttccgttagtatcgcccttgaatttcaagccctcattgattttagcgatgtttttatcaatcgcatctttgaaagtacttggtgcgttactactggtctcatttccacttgcatctttcaatttcgcaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaatttttccccaacgcaatagaatcccctgcggcggtttcaacctccgcaccttcaccaatcgctaccgcacctgcggctttggtttcggcatctttaccgatggcgatagctcctatggcagttgtagcaaccgtcgcttttttccccaacgcaatgccgtaatcggcttcgactttggcaacgctaccgatgaccaccgcggctttccccgaggctttggtgacttgtgagttgccgcttccggtatttgtgccgtcatcgtctgccgtgccgataacgatactgtacatgcctttgctcatttccgttttcgctacgccaatggctaaagaatgatcagctttagcaccatcgttgtttttattcgtttcagcagttaatttattaacagagaaatacgagactccgccaccgccggcatttttcatcgcttctcgcaattgccctaaattgacggcgtgtgtatcttccgtccccggtgcgacattcacgatttgacggtattttgtatcttttttaccgattgatagtgcaccgccgagtttgtcttcaaatttcttagcaaattcctcacttatccatgtttttgctttagcatcagtcttatcatcttttgtaatcatagaagagccatttcctgacggactatcagcttcagattcagcacccaaagcgattgcatcggtatgttgattatccactctcgcattgtaaccaatagcgacggctttttgagactccacagaagaatgtgcccctaaggcggttgattgtgaaccttttgcataagcacgatgccctaaagcaacatcgtcaatttgctccgcataagattgcatacctagtgctactgtttcgttaccataggctatggcttccgaacccaatgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatcatctagaattgtatcgggtccaatttttgattcgttagctgttaaaccactcaaaactatattaatatcctgaccatacacaaaactcccagtcaataaaaacgccaacggcaataatttaaacagccctaaaaaattgcccgaaatcccaccgcactttggtttattttcagaacggctcgccacttggcaatttttcgccaattcagacaccactttggtttgtccagtggttatatcgtatttggttttgaaaatcttattcatggtttactctctttaatcttttaaaatgggttatttaataatttattttgttgatttttttcacttttttatggttgtgaatggattaaactttttgttttttaggtagattaatgaggtataaatcggcgatgccttgctttttaaggcaaagcagaaaaagacgaatgatattttcgcaaaggggtttaaaaggggaaatttgggtatgatgaaaagttaaaaactttttaaaatttattttgcaaggtttataaaaaggcgttagcctaggctgtaggctgtaggctgtaggctgtaggctgtaggctgtcattttttcttttctattttatttgtcaagtaatcattaagcagtagaattttgcgattctatcctaaattttattaagaatgaaatagttttttcattttttttgtttcgatctcgattatatagtgaatcaagatgtttgaggggaaagataaaggcggagtttggcttttttttggttctaattacaggttatgttttggcgagattgctatataatgtcgaattatcttaccgatttatcaattttcttttctttgggagtaaaagatgactcaagcgaagatttattccgtttcacaacttaaccaatccgtacgccaaatgttagaagggcagttagggtcggtttggttgacgggagaaatttccaattttactcagcctgtttcggggcattggtattttagtttgaaagacgaaaatgcacaggtgcgttgtgcaatgtttcgcatgaaaaatatgcgtgtcggatttaaagcacaaaacggaatgcaggttttggtgagagcttccgtgagtttgtatgagcctcgtggcgattatcaattgattattgagtcaatgaatcttgcgggggatggcttattgcaacggcaatttgaggcgttaaagttaacattggcggctgaagggttgtttgcacaacattacaagaaaaacttaccgcactttgcaaaatctgtcggtattattacgtcgcctaccggtgcggcgttgcaggatattttgcatattttgcaacgtcgagatccgagtttgcatgtagtgatttatccgactgcagtgcaaggcaaagaggcaacggcagaaattgtacagatgattgaattagccaataaacgtcgggaagttgatgttcttattgttgggcggggtggcggatcgttagaggatttatggtgttttaatgaagagagggtggcaagggctatttttcattccgagttgccgattatcagtgcggttggacatgaaattgatgtaactattgcggattttgtggcggatttgcgtgctccgacaccttctgctgccgcagagcttgtcagtcgtaatcaacaagaattattggatcaattattttaccgcaaacaacgtttggatatggcattggatcgtttgttccaacaaaaagtgaagttgttgcaacgcttgcaatttcgcttgcaacagcaacatccgcaaagccaattaaaaattcaacaaaaaacggtgcaacaattactttatcgtttacatcttgcgttaggtgcttttgtcgataaaaaacagcagaaaatgaccgcactttgtcgtcgtttagacaattcacctttgccttattatgtgcaaaaacagcaccaaattttggttcaattggagcttcgtttgaatagcggattacaaaaaaaattcaaaaatgccgattatcagcttagtcgattatgtggaaaattagacagtttgagtccgttgaaagtgttggctcgtggttattcgattacgaaaaatcagcagggacaggcgttgaaaaacagtcttcaaattgaggtcggacaactgatcagcacgcaattagagcgagggattattgttagtcgtgttgaagcgatggaagagtaaactaaaggtgcaaataggtttgctcctttagtttgtgtatgggttgggggagttagttgcgtttaccgaaaatagcggttccgattcttaccatggttgaaccgcactttattgcacttgccatgtcatcactcattcccattgataatgtatcaattttttcatcaggaaacgccagttgtagttgagtgaataaatatttcatttgattaaatgcttgttcttgtgcggtgatattatcagtcggttcaggaattgccattaaacctcgtaggcgtaagtgcggtagattttggatatgttttgccaaactcaacatttcttgaggttgaatacctgatttgctgttttcagcactgatattaatttgaattaggacatttagtggttgtttatagtgaggtcgttgttcatttagacgagtagcaattttttcacgatcaagcgtttgcatccaatcaaagttttcagcaactaattttgttttgttggattggagcggtccaataaaatgccattcaagttgaatatgttgttctgtaaaatattgaattttttcaacaccttcctgcacataattctccccaaatgctgtttgccctgcctgataagctatcagaatatcctcgaccggtttggttttactgactgctaataaggatactgtggaagaatgtctttttgcctgttcgcaatattgagatatttgtcggtttattttcgctaaattgttttttatttgcatcataatgagcaagacctgttgaagttggtttgatatgggcattattttaccttaattattcgacagggggaaatttatgaaaaatttttcattttctatttgacaatagcataaaatttcggtatttctaacgcactcttttttgattttgaaataaccgaatgtataaccgcactttttctattaccacgatgattattaccattaagatgattaatggcgtgggctagtgcataaaaaataggatttacaaagcccgcctcgtaaaaaagtgcgggtttttttattaacgtttttattattaaatcttcacaacatataaggaaaaattatgcgagtactcaaatttggcggcacatctttagcgaatccgcaacgctttttacaagcagcagcacttattgaaaaagcacatttagaggaacaagccgccggcgttctctctgcaccggcaaagattaccaatcatcttgtagcactttctgaaaaagccgctttaaatcaacctactgatggtcattttgatgaggctcttgagattttttataatattattaatggcttatatgcagaaaatactcattttgatcttgttggcaccaaagcattaattgagtcggagtttgcacaaattaagggattattagaaaacattcgtcaggcgggaaaagtagaagatgcggtaaaagcgacgattgactgtcgaggtgaaaaattatctattgcgatgatgaacgcttggtttgaagccaaaggatatacggttactgtgattaatccggtagagaaattattggcttatggatcttatttggaaagcagtgtggatattgcggaatcaactaaacgagttgatgcaaaatctattcctgctaaaaatattgttttgatggcaggatttacagctggaaatgacaaaggcgaattagttttattggggcgtaacggttctgattattcggcagcgtgtttggctgcttgtttaggtgcaagtgtttgtgaaatttggacggatgtagatggtgtttatacctgtgatcctcgtttagtccctgatgctcggttactttccagtttatcttatcgtgaagcaatggagctttcttattttggggctaaagttattcaccctcgcactattggtcctttagttgagccgcaaattccttgtttgataaaaaatacgggtaaccctgaaggtgcaggatcaattattgataatcgtgaaaatatttctgaagggctacaggttaaaggcattactaatttagataatgttgctatgttcaatgtatcagggccgggtatgcaggggatggttggtatggcagcgcgtgttttttccgccatgtcaaaagccagcgtttccgttattttaatcacacaatcttcttctgaatatagtattagtttttgcgtaccgactaaagctattgaaaaggcaaaagcggcactaaatgctgagtttgaacaggaacttgtcgctaaagatcttgatcctgtggaagtaattcatgatttgtcaattatttccgtagtaggtgatggtatggagcggtctaaagggattgccgctagtttcttttcggcgttagctagtgctaatatcagtattgttgctattgcacaaggatcttccgagcgttcgatttcagcggttgttcctttgaataaggcgattgaagcggttaaagcaactcatcaggcattgttcaataatcgtaaagttgttgatatgtttttagtcggtgttggtggggtcggtggtgaacttattgaacaaattaaacggcaaagtgaatatttggcaaaaaaagatattgagattcgtgtttgtgcgttggctaattcgaataaaatgttgttaaatgaaaatgggttaaatcttggtaattggcgtgaagatttggcaaatgcaacacaaccgtcagattttgatgtattgctttctttcattaaattacatcatgtggttaaccctgtttttgtggattgcacaaccgctgaaagtgtagcaggattatatgaaagagctttgaaagaaggctttcatgtgattacaccgaacaaaaaagccaatacccgtgagctggattactataaccaagtgcgtgaaaatgcacgtaaaaatcatcgtaaattcctttacgatactaacgttggtgcaggattgcctgtgattgataacttacaaaatctattagccgccggcgatgatgtagtgagttttaacggtattttgtcaggatctctctctttcattttcggtaagttggaggaggggctttctctttcagaagctaccgcacttgcccgtgaaaaaggctttacagaaccggatccgagggatgatttatcagggcaagatgtggctcgtaagttattgattttggcacgtgaaatcggtttagaacttgagttgtcggatattgaggtagagggcgttttaccgcaaggtttctcagagggaaaatcagcagatgaatttatggctatgttaccctcattggacgaagaatttgccgagcgtgttgcaaaagctcgtgcggaaggtaaagtgatgcgttatgtgggacaaattgaagaagggaaatgtaaggtttctattattgcagttgatggagatgcaccgttatataaagttaaaaacggtgaaaatgcgttagctttttatactcgttattatcagccgattcctttgttattgcgtggttatggtgctggtaatgcggtaacggctgccggaatttttgccgatattttaagaaccttaaaacattaattggagtgataaatgttaagaatttatgcacctgcatcaagtgcaaatattagtgttggatttgatacattaggggttgcagtatctcctattgatggttcattgttaggtgatgtcgttcagattgaagaaattgaacagggatttgaactggaaagtgcggggtattttgtgcgtaaattgccaaaagaaccgcaaaaaaacattgtttatcaagcctatgtgttatttagtgaacgtttaaaattacgcaatctgaaaataaagccgttgcgtttaacgttagagaaaaatatgcctattggctcgggattgggatcaagtgcttgttctatcgtagctactttagtggcgttaaatcaattttatcagcagccattttctaaaatggaattgctggaaatgatgggcgaactagaggggcgaatttcaggttcaatacactatgataatgttgcaccttgttatttgggcggtgtgcaattgatggtgcaatctctaggtaatatttgtcagcaattacctttctttgataattggtactgggtattggcttacccgggaattgaagtttcaacggcagaagctagagcaattttaccgaaaagctatactcggcaagatgtgatttctcatggtcgtcatttagggagttttgtacacgcttgtcatactcggcaggaagcattggcggcttatatgatgagagatgttattgcagaaccttatcgtgaagcattattgccaaattttgctgaggttaaacaggcagtgaaggatttgggcgtacttgcttcaggcatatctggttcaggtccaactatgtttgcgattgctccggatttagctattgcgactaaatcggcaacttatttagaaaacaattatttacaaaataatgagggctttgtgcatatctgtaaagtggataatgtgggtgcaagggctttagtttaacgagaacaagttatgaatttatataatattaaacatccggaacaacaagtaagtttttcacaagctgtgcgtcaaggtttaggaaaagatcagggcttattttttcctgaaaaattaccgcactttgacgacattgatagcctcttatctttgcctttggttaaacgcagtcaaaagattttaactgctttaattggtgcggaattgtcacaagaaactattagtgcaatggtaaaaaatgcctttacatttccggcaccgatggtcaaagtagaagataatatctatgccttagaattattccacggtcccacgttagcttttaaagactttggaggacgttttatggcacaagccttagcagctgtgcgtggagacagtaaaattactattttaactgctacttctggcgataccggtgctgcggttgctcatgctttctatggcttagaaaatattgaggtagtgattttatatccaaaaggtaaaataagtccgttacaagaaaaattattttgtacacttggcgggaatattcgaactgttgcgataaacggtgattttgatgcttgtcaagcattggtgaaacaagcctttgatgatgaagaacttcgtcaagctgttggtttaaactctgcgaattcgattaatatcagtcgcttgttggcacaagtttgttattattttgaggcggttgcacagttaccgaaagaaatccgtcaagacattgttatttctgtgccgagcggtaatttcggtaacttaacagcgggattaattgccaaaactttaggcttaccaatcaaacgctttattgcggcaaccaatgccaatgataccgttcctcgctatttgaatagcggaaaatggcagcctcatacaacggttgcgactctttccaatgcaatggatgtgagccaaccgaataactggcctcgtgtagaagaattatttaaatataacggctggtctttaagtgaattgggttcaggtgcattgagtgatgaagaaacagaaaaaaccttgcgggcacaatatgccaaaggttatttatgcgaaccgcatggggctattgcgtatcaggtgctaaaagatcaattacaggttaatgaaacgggtattttcctttgtacggcacatccggcaaaattcaaggaaaacgttgagcgtattttaagtctcgagcttgtgcttccggaaacattggataggtacaacaaattgccattgctttctgatgaaatggaaaatgacttcgctcaattacgtgcttatttattaaaaaaataaagcattttaaattaaaagtgcggttgaaagtcggaaagtttcgattttatgtacatataataaaagagtgggattcccactcttttgtttgctgtactgtttttttagacaagaaaaacttttaattcgggagcttatgcctctgattttcttgatagacttgcttgaattttattttttgccactttcatcacagttttgtacattgctacattttccgtaaagatacagattgtgtgtttttaatttgatgccatgttccgcactgatttcacgttggcgtttttcgataacttcatcattaaattcaaacactttgccacaatcgacacaaataatgtgatcatgatgttcttccggtgctaattcaaaaacagatttgttaccttcaaagttatggcgaataagaatatttgcctcatcaaattggttaagtacacgataaacagtggctaaaccaatatctttaccttgttccagcaacattttatagacatcttcggcggagaaatgttgcattgtgcctctactttcttgcattagagacaaaattgttaagcgtggttctgtaatttttaaacctgctttttttagtagcttgatattttcttcagacatggtagctcctcaaattttatgccagttcagctaaacacatttcgtcatacacttgtttaacccatttttctacacgttctgcggtgagttctggttgacgatcttcatcaatacataaacctacgaatgtattgtcatcaactaaggcttgcgagacctcaaaagtataaccttcggtcggccaatgcccaacgataattgcaccttttggttcgataatattgcgtaccgtacccatcgcatcacagaaatactctgcatagtcttcttgatccccacaaccaaaaatagcgactaatttatcggtaaaatcaatttcttctaaggttggaaagaaatcgtcccagtcacattgggcttctccataataccaagttgggataccgatcattaaaaaatcatagctttcaatgtcttctttactacttttagcaatatcacgaatatcaatgagttctgaacctaattgtttttgtatcattttagcgatattttcagtattacccgtatcactaccataaaataaaccgacaatagccatttttatctatttccttgaattttaaaataatcttttaagatcgttataattaactctcaatgactaatcgcttgttcagacgcctgacttctaactgctgaactaaatccacatgtaacttttactcaatacgttttagaatgctaaatttatcgcattgaagttgattacatttgtttattcggagctgttgttcatgaagcagtgaatttgttctaggcgtcctactttgggaagcgtcgcaaacagatttagtgtaatacaatctgcatcttgtttagccgttttcaaaccactgaaaatatatcaattctagcctggttctaattgagaatgataagctacaagcaaaatttgaagcgaactataacacaatttataagtgaattaaaccctatagatcaagtaaacatgagaatttttatgacaaaaaacgctgaattgatctaatcacaaaatctgctttttcagcatgtacccaatgcccacttccattgattgtaaaagaggtcgcttgtggaaattgagcgagaatttgttcactgtattccggcaaaatgtaattcgataatccacctcggataaacagtgttggtttgtcaaaaaatcctttttcccaattcataatattggcgtaattttgtttaagtgcggtgagattaaagcgaaatttttcttttgcttgtgcatcgaaagacttgagcataaattgctgtacgctttcttgtggaatatagttagccagtaattgttttgcttgttgacgagtttccgattgtgctttacttactgcaaaaagtcccgcaaatacgctgtcatgcccattgttgccgtaattgactggtgcaatatcaatcacaatgagcttttctattaagtgcggtcgtagcattgcacatttcatcgctgtttttccacccatagaatgcccaattaaaataacgttggttaaattcaaatgatcaatgacttgtagaacatcttccgccatcagctgatagttcatttcttcactatgaaaactttgtccatgattacgtaaatcaagacgtaaaatagggtatttttcggaaaaagcacgagcaatgacaccaagattattcatatcaccaaataaaccgtgaatgaaaacaagagtgggggagatttgcgagttgtttatagcgttaaattggtaattgagtaatttagtcgtgggcataatttttgcgtgtgtatttgtaaagaaatcgttataatgtgcgaaaaattcaaatagatcaagtagaaatctcttgtaggcttgtaatgtaaaaggagttcggttatgaaaattattgaagttgacgaagagctttatcagtatattgccggtcaaacgaagtctatcggtgaaagtgcgtctgatattttacgccgtttgttaaatcttccttattctaacgtagcaagtgcggtacaaaattcggaaaatgtatctacagaagcgattttaccaaacacttgtatagaaagcgaacaggaagttcaaacgaacgaattaataaatattcctgtcaaaaagcagtctgatgaagctattcagaaaattgttgataaagtaagaaatcttttatattcagaagaattccagcaagaaacgaaagctgttgtgcgttttttgagcttgttgcgtacactttaccgcactaatccggaaagttttgcattggcaacggaaagtttgcaaggtcgaacaagagtttatttcgcacgtgatgaggctactttactggtagcgggtaatcatacaaaaccgaaacaaattcccgacactccgttttgggtgatcactaatactaatagcggtcgaaaaatgttgatgttggaaagtgcgatggaatctatgcatttaccacaagaactcattgaagaagttagatctttttttgtgacgaattagcgatgttcttttggcataaatatgcactcactcccttatttcaatcaaaaatagccttgcgaaactcgcaaggtgaagtctttacttggcaacaactttgttctttaatcaatcggcaatctctactttttcagcaacaaggtgttaaagcaggttcgggcgtgttgttatgtggtaaaaatgatttttcattattgttggcttatttggcaactattcagttaggagcaagagttttaggtgttaatccgagttttcctgccgataaaattcagcatatcgcagaatgttatcaatgtgattttatttttaataggactgctttcctgtttaaaaatatgcaaaatttgaccgcactttctgtgagcgactgtacgcaatatgtagatgttttacctgaaactgaagttaaaatggatttgcaggctgtggcaactttaactttaacttcaggatcaagtggtttaccgaaggcggttgtacatagtttgcaggggcatttagataatgcgattggcgtttgtgagctaacccaattcagtgcaaaaaacagttggcttttatctttgcctttatttcatgtttccggacaggggattatttggcgttggttggtaagcggtgcagaattgcatttaccgcaagaggatttttatttttctgttagtcaggcaagtcattgttcgttagtaccgacgcaacttcaacgtttattcgattattggcaacaaaatcctactctctcacgttacacagagcatattttgttaggcggtacgcaaattcctacgcagttgactgagaagttggcacaatacagtataaaaagttacaccggctacggtatgacagaaatggcttcaacggtttgtgcaaaattgagtgatggtaaacgtggagtagggcagccgttagcggggcgtgaagtgcggttagtttgtgatgagatttgggtgcgaggtgccggtcttgctttgggttattggcaacaaggtaaaatttgttctttactgaatgaacagggttggtttgccacaaaagataaaggcatttggcaagataatgaattgcacattttaggacgcttagataatatgtttatctccggcggggaaaatattcaaccggaagaaattgaacaaattattggacagaatgaaacagttgaacaggtttttgtattaccggttgatgatgttgaatttggacaaagacctgtggcaatgattaaatttcacggcattttttctgagcaggcagtatgcgaattacaaatttggttagcggataaattggaaaagtttaagcaacctattcaatattttccgttagtgttgcaagcacagggaaatattaaagtttcccgtcatcagttgaagtccgagctaactcgtttattaggaaagtaagtatgaagaagataaaaaataaattcaaacaagttgccatgattggcttattctctttagctcagtttgcactggcaggagcaattttgaccgaaaatgatgtaaagatgcgacttgatgagattaaaaaaatcgaacaaccccagcaagaagataaaagtgcggtgcaaaacttggaagaaacattgtttctcttaggaaaaatagcaaaacagaaagaagacaatctaaagttacaaaaactgattcaagatgcaccaaatgagcaaaagaacatcagagaggaaatcactacattaaaagaggcgtttgttgttcgtgattttgataatttgtccatcgggcaattagaggataacttagcaaaaatacaatccgaattacaacaagttcaagctgatttagtacaagctaatgcacagttagttaatcaacattctgcaacagagcgagcacaaagtgcgttaagtgccaatattgttcgtacacaagaaattgataaattgtcttttagtgttgatattgcacctgaggagcaaaataaattagctacagaaagtgcgttaattgaattacaaaatgactacaatcaaactgtattacaagggaataatgaactcaccgcactttatactttgcaattagaattgaaaaatcttgtccaacagcatttacaagctacgcaaactgcgttacagacggaaattaatcgacgtaaattagtgcaaactgagcaacatgtggagcaactaaaacagattcaaaaggaagcagagggtaatccgttattagttcagcaacaacaaattaatattcagattggacaagatttagtggaacaaacaactaagctgaacgctttgtcgcaagacaatttgcgtattaaatctgttttggataatttgcaacaaactgaacgtaatattaatgaacaaattagtgctttacagggaactttagttttatctcgaattattaataagcaaaagcaattattaccgcacgataggatgattacaggattatcaaatcaaattgccgatttacgtgtgaaaattttcgatttaacggagttaagagatagcctttatgatattgacggttatatttccaatatagaaagaaagcaaggggttacttttggaatggctgaacactcacagctcagcaaaattttacgggagcgtcagaagggtatttctgatttggtgtctattttaaatgatcaactcaatctttcaatcaatattgaattaaatcaaaaacaagtcaatttaattagtgatactttacaagaaaaactccaacaacaaagtttctgggttaagagtaatacacctattgatttggattgggttaagcgttttccttcactactaaaaatagaattggaggatattcgtacgcaatttaatttcaacaattggcaagataatattatttctgccactgcgttaattgttttcctattatccattgccttttttatttcttggcgtaaagaaaaaattaagcaacggttgaattatattaatagcaaaattaatacgttacaggaagatagacagctttacactccggaagctgttttttggacgattattctttgtttaccgatgacgttagttgtcttagtcggtttaattgttattacttttatttgttttaatgatcctgaaaaattctggttgtggtcagtaagaatgtcgggttattggtggcttttcgcttttatgttagcgatgttacgcccaaatggccttgcttatcgtcattttagtatgcctaaacataatgtagagcttttttccaatgtgatgaaacgatcagtatggattactgttctttggcttaatgcctctatgtttacttatttagatggaggaattgctaatgatgtgattggtcaattgatgacaattgcggtcttagttatttcactgtttattattggacctcgtatgcgttatgcagtccaagcttatgaaaaaaactcagaaaaaaaacctttcctaaaagttttccgtattgtgttgctactctctcctattattctcattgtgttggtggttttaggttattactacactacgttaaatttgatggatcatttgatgtcttcttattttgctttaatgatatggatagtaattcgcaatatagtgtatagaggatttactatttctgctcgtcgtttagcttatcgtcgtttgcaagaaaaacaaaagaaaacacaggtacaatctcaagatgtggtggataaagaagagtttaaccttaatacacaagaggaagttttagcaatttcagccgttaaggatcaagttttgcgagtgatggatttagttttactcgtcggcttaatcggtatgttctattgggtttggtctgatttaattacggtagcttattatttggaaggcgtaacgttatggaaacaaactgccataacagaagttggtacagttattgaaactattaccctgtggaatttgttattagcactgattattttaggcatcacgtatgctttagtgcgaaatattggtggggtattggaagtattaattttttcaagagttaatttttcacaaggaacaccttacaccataacaactttactgatttattttatcattgcaatcggtagtgctatggcattctctactttgggtatgtcatggtcaaaattacaatggttatttgccgcactttctgttggtttaggttttggtttgcaggagatctttgctaactttgtatcaggtatcattattttatttgaacgtcctgttcggattggtgattttgtaacaattgacaatttttcaggaactgtgtcaaaaattagaattcgttccacaacaattatcgattctgataagaaagaagttattgtacccaataaagcctttgtaacagagcgaattgtgaattgggcattgaccaattctatgactcgtgttgtgattggtgtcggtgtggcttacggttcagatttagaattggttcgtaagttgttgttgcaggcagcgtatgaaacacctacggttttaaaagaaccggaaccgtctgcttattttatagcgtttggtgcaagtacattagatcacgaattgcgggtttatgtgggtaaattgtcagatcgtatgactacacaagactttttaaatcgtcgtattaatgaactatttgcacaacataatattgaaattgcatttaatcagttggatgtatttattaaaaatcaaacaacaaatgaagaagtaaaagtactttcagagaatttacaaagataaaaggaataaaaaaatatggcgggaaatagtattgggcaacttttcagggtaacgacatttggagaatcccatggtattgcgttgggctgcattgtagacggtatgccgcccggacttgctttatccgaagatgatattcagccggatttggatcgtcgtaaaccgggaacttcaaaatatactacgccacgccgtgaagaggataaagtacaaattttgtccggtgtgtttgacggaaaaaccacaggaacaagtatcggtatgataattaaaaataccgaccaacgttcgcaagactatggtgaaataaaagatcgttttcgtccggggcatgctgattttacttaccagcaaaaatatggtttacgtgattaccgtggcggagggcgatcttctgcacgtgaaacagtgatgcgtgtagctgcgggggcaattgctaaaaaatatttgcgtgagtattttggtattgaagtacgaggttatttatcacaaatcggtgagataaaaattgatccgcaagtggtagccgatgtgagtaaaattgattgggcgaaagtaaatagcaatccatttttttgtcccgatgaaagtgcggtggaaaaatttgatgaattgatccgagaattgaaaaaggcaggaaattctattggggcgaaattaactattgttgctgaacatgtgcctgtcggtttaggcgagcctgtttttgatcgtttagatgcggatttagctcatgctctcatgggaattaatgcggtaaaggcggtcgaaattggtgacggttttgcagttgttgaacaaaaaggaacggaacatcgtgatgaaatgacaccggaggggttttgttccaaccatgccggcggtattttgggcgggattagctctgggcaaccgattatcgctaccattgcgttaaagcctacttcgagtattaccgttgtagggcgttcagtgaatttaaataatgagcctgttgacgtgattactaagggacggcatgatccttgtgtgggaataagagctgttccaattgctgaggcgatgatggctattgttttattggatcatttattacgctttaaagcacaatgtaaatagaacacataactatgttaagaaaggtaaagttaatgctgaaaactgcggttttttttaccgcactttttttcactcagatattaagtgccaatccacaatattggcaatcagtgaaacgacctattcatggtgaggcaatgcctataggaagttataataatggctgtcttattggtgcggaagcattgccctttaatggcgagggatatcaagttattcgtactaataaaaatcgttattatggacatcccgatatgattgcttatttgcaacgtctcggtaaaaaagcaaaacaggaaggtcttccaacgattttaatcggtgatattgctatgccgggaggaggacgatttttaaccggacatgccagtcatcaaatgggacttgatgcagatatttggttgcgtttaggtaaactttcggctaaagatgcacaagatccaagtggaatgggactgttggttgttgaccgaaaaaaacagagagtcattgataaattgtggtcaaaagatcatgaaaatctgattcgtttagctgctcaagatccacaggtcagccgaatttttgtaaatcctgcgattaagttgaaattatgccaaacagtaaaaggtgatagaaattggctacaaaaaattcgcccttggtttgggcatgatagtcatttccatgtgcgtttaacttgtccaaaagatgctaaatactgtgaaaatcaattgccaattccggcgggagagggatgcggtgaagaactttattcttggtttaaacctgctaaaccaagtgaatttaagcccaaaaaagtggtgccggaagccccttttctttgtcaacagttaataagtgcaccaaatcgtcatgagtggttagaataggaataatatgatagtagaaattactcttcaactaatgttaattttgtttttggtcgctatgatagccggctttatcgatgccatggcaggaggtggcggtttgattactattcctgcactattgatgactggtatgtcgccggcattggcacttggtacgaataaattacaggcttgtggcggttctttttctgcaagtttatattttttacgcaaaagagcggtagatttacgtgcttttttgttgattattgtcatgacttttttgggggctgcattaggcactttatctatccaaagtgttgatgcaatcttaattaagaaagttttgcctttcttggttttgattattggcttatattttttattgactccatcacttggtaataaggatagacaaccccgtatttcttatagtttatttgcattcagtatcggtctgacagttggtttttatgatggtttttttggtcccggaacaggctctttactgactcttgcttgtgtaagtttactcggttttaatttagcaaaagcaacggcacatgcaaaagtgttaaattttacttcgaatattgcatcattgctttttttcttacttggagaccaaattttttggaagttgggcttggtcatgatgcttgggcaatttattggtgctaatttaggcgctaaaatggtattaacaaaaggaaaaaccttaattcgtcctatggttgtattaatgtcttttattatgacggttaaaatggcttatgagcaagcttggtttagctggtaaaccgatgaattattggagtaaacatgacagaaaataatgatttacgtttaaccgcacgggtcggatatcaacctcattactcttggtcctatttattgcctaaatattggggtatttggctcggtatttttgctttagtaattttagcttttgttccttttcgctggcgagataaattggcgacaaaattgggcagaattatcgctcgtaaagcgaagaaacagagacatcgtgctgatgttaatttgcgttattgttttccgcattggtcagaaaaacagcgtaatgaagtgattgaaaatatgtttattactgttactcaagtgatgcttgggatcggtgaaattgcattacgttcaaaaaaacacctgaaaaaacgtagtgagtttaaagggttagagcatgttcagcaggcaagagcggtaggaaaaaatattattttaatggtgccacatggttgggcaattgatgcgtcggggatcattttacatgcacaaggaatagcgatgacttctatgtataacccacatcaaaaccctcttgtggattggttatggacgatgactcgtcagcgtttcggtggaaaaatgcatgctcgtcaaaatggaattaagccttttcttaatcatgtaaagaaaggtgaaatgggctactatttacctgatgaagattatggtgaggaattgagtgtttacgctgatttttttgctacttataaagccactttgccgggattaaataaaatggcaaggttggcaaaagctgttgttattccgatgtttccacgttataacgcacaacgtgggaagtatgaaatagaaatttgtgcacctttagaattaacggaagatccagaacaatcggcgagaatgatgaatcaagcaatcgaatactttgttactccaacaccggagcaatatgtctggattttacgcttattaaaaacccgcaaagataatgaagatatttatcgttagcttgggcaatttgtgctaaactttgtgccgttttgttgaataaacttttctcatagaatcagggaataaaatgaataaattagaattgattaaatcctctattaaatctattccaaatcaccccaaagaaggaattattttccgtgatattaccagccttactgaagtacctgaggcatttcaagcaacaattgacttaattattgagcgatataaaagtaaaggaattactaaagtgatcggtactgagagccggggatttatttttggggcgcctgttgctttggcgttaaatgttccctttattttggtacgcaaaccgggcaaattacctcgtgaaactatcgcacaatcttaccagttggaatatgggcaagataccttagaaatgcatgtaagttctattcaagccggtgataatgtacttgtgattgatgatttattagcaactggtggaactattgaagcgactgtaaaactggtagagcgtttacaaggtcaagttaagcatgccgcttttgttattagtttgccggatctcggtggtgaggttcgtttacgtgaacttggtgtggagccatttactttagtcgaattttcaggtcattaatttcttcaaattaatagagatagataggcaatgagttatcaagtattagcaaggaaatggcgtcctaaaactttttctgaggttgtgggtcaagagcatattttgaccgcactttctaatgggttatgcgaaaatcgcttgcaccatgcctatttgttttctggcactagaggcgttggaaaaacttctattgcacgtttatttgccaaaggtctgaattgtattaggggggttacggcagaaccttgtggtgaatgtgaacattgcaaggctattgaggaaggtcgttttattgatttaattgaaattgatgctgcttcacgaactaaagtagaagacaccagagagttgcttgataacgtgcaatataagcctactcaaggtcgctataaagtttatctgatagatgaagtgcatatgctttctcgtcattcttttaatgcgttgttgaagacgctggaagaaccgcctgaatacgtaaaatttttattggcaacaacagatccgcaaaagttaccgattacgatcctctcacgttgcatgcaatttcatctaaaagctttatcagaaaaacaaattgcacagcatttagaatttattttacaacaagaaaatattccttttgaatatcctgctttggaaaaattggcaacagctgcacaaggtagtattcgagacagtttaagtttaactgaccaagctattgctatgggcaacgctaatgtaagtttggatacagtaagtatcatgctgggcttattggatgacaatcagcctattgatattttatatgcgttacagcaaggcaatggtgaaatgttaatgaagtcaattcaagctgtagcggaaaaaggtgctgattgggataagttactggtaactttagcggaaaaattgcatcaaattgccatgctacaacttctgccacagcaaataaatgaagaaaactcgcttggatttttagctaaacatattacgccggaagatgtacagtttttttatcaggttattgttagtgggcgtaaagaattagcatctgcccccaatcatcgtattggtgccgagatgattttgttgcgatccttagcgtttcaccctaagttcattagtccttcttcagcagcaccaatagaacaaagtgcggtgcaaaaatcacaaaatattgttcaaccgtctttagttgagatgcccgttgtttctgttgccgagcaattaccttcgcaaaatctcattcgtaaaccaacgatagcagataaggtcgatactaagttaagtacaacagctttaagtgctttagaagcgttagaacagttgtcacaacctagtgatcattcagatagcgaaaaaaaaaactcgccgatagataatattcatgatatttctttaagagaaaacactgaaaatatctccgcacttcctgttctaaatgttgtgcctaaagatgttgataatgcacttaagacggttactgtcattgataagagtgatcatagaagtgatgaaattcaagaggatagtgctgagaattatcgttgggaatggcgaaatccggaaatggcggttgaggaaaaggctattcgtccttctgaaataaagcaagctattttagaacaagcttctccggagctcatacaacgtataattgctacggcacaagaaagagatgattggactcggatcattgagcaattacctttgagaggtatgacaaaagacatggcgttaaataccgttctattaaatcaatcgggggatcagatcgttttatccttaatgtctgataaacagcatttgttagatcgttgtcataaagaattaaagcaagcattatcggatttctatcaacgtgatattcagttattaatcacacctactgacgataaaaatttagccactcctttatattatcaaaacttagtttatcaagagtttaatgagcaagctaaaaaagcgttacaagaagataacagcctaaaattattagaaaaagaatttgccgctacgctggatttggatagtgttagaccgatttgacatttttactacgatttagatattgtcttgagctttgagcaatgattatataatgatgaaaaaagctaaaaatcgactgcactttttctttatttgcgatccggatcgcataaatgttttttgatgacaaattctcttttcccaaatacaagaaaattgctagattaatcctattgaacaaagtacaatctccgcctctttttgatcatcaatgaatgccataaggtgtaataacggggcaataaataataaatgtcggacaaaattaatttaatgaatttaactcgtcagcaaatgcgagcattttttcaggagttaggtgaaaaaccttttcgagcagatcagttagttaaatggatttatcattttggtgaagataatttcgatcatatgactaacattaataaaaaattacgtgaaaaattaaaaactgttgctgaaattaaagctccggaaattgcagttgagcaacgttcagctgacggtacgatcaaatgggcaatgcaagtaggagatcagcaggtagaaaccgtttatattcccgaaacggatcgtgctacgttatgtgtatcttcacaagtagggtgtgcattagcttgtactttttgttcaacggctcaacaaggttttaaccgcaatttaactgtatctgaaattattggacaggtttggcgagcttcaaaaattatcggtaatttcggtgttactggtgttcgtcctattacaaatgtggtcttgatgggaatgggagagccattattgaatgtggctaacgttgtaccagcaatggaaattatgttggacgattttgcttatggtttatctaagcgtcgagtgactttatccacttccggtgttgttccggcactagacaaactgagtgaaatgattgatgtggcattggctatttctttgcatgcaccgaatgatgaattgcgtaatgaaatcgtgcctattaataaaaaatataatattaaaatgttgatggagagtgttaatcgctatttaaatgtttcaaatgcaaatcacggtaaggtaaccattgagtatgttatgttagatcatattaacgatgggactgaacatgcacatcaattagcagaggttttgaaaaatacaccgtgcaaaattaatttaattccttggaacccgtttccggatgcaccttatgctaaaagctcaaatacacgtatagatcgttttcaaaaaactttgatggagtatggttttacagttattttacgcaaaacaagaggtgatgatattgatgcggcatgtggtcaacttgctggtgatgtgatagatagaacaaagcgtacggcacagaaaaaacggtttggaaaagaaatcggcactcatcaaatttattaactatttttaatgtataaggagagaaaactaatgcgatatcggactatatttacttttattatattctctctttttctttctgcttgcgtttctcagcctacaactggtcgctttaataagcaacaagctgcaaaagcacgaattgagttaggtttaggttatttaaaattacgcaatttttctcaagcaaaacttaattttgataaagctttattctatcaacctgactattatttggtacattcggcttttgcctatttatatcaattacaaggtgatatttcgcaagcgaaatcctcttatgaaaaagccatcagtttggataagtcgcaaggtgatgtgaaaaataattatggtgcatttttatgtagtcagggcgaatttgctcgtgcttatgagttatttgagcaggcacttattacgcctaattattatcagcaagcggatacctatgcaaatatcatcatttgtgcagaggcggaacataatattccacgttatcagaaatttttacagttactgaagaatattgatcccaaaagagcggaggaaataaagaaagtttcttagcttagttagcgtgagttgaaagatcaaaaatggcaagactgtcttcttgccatttttattatattatgattttttgatgtaattagattttacaagctcctcctgcacaagcgtcatcaagatcttcttgcatatcttctgcaccatctctagtgttttgataatacagggtttttaatccatatttgtaggcagttagtaaatcttttaataaaaccttcattggtactttaccatcttcaaaacgttttggatcatagttagtattcgctgaaattgcttggtcaatgaatttttgcatgataccaactaagtgtaggtatccatcattacttggaatatcccacagtaactcatagttttcacctaaattctcataatcaggaacaacttgctttaaaattccatcttttgacgctttaatactaacatgtccacggggaggctcaattccattggttgcattagaaatttgagaagaggtttctgatggcattaatgcagttaatgttgaattacgtaaaccaaattcttgaatttctttacgcaaggcttcccaatcgtaatgtaaaggctcttttgttaagttatcaatatcttttttgtaagtgtcaataggtaagatcccttgtgcataagtggtttcatggaagtattcgcaagcaccgatttcttttgccaaattcattgaagcttttaataagtaatattgaatagcttcgaaagtgcggtgtgttaaatcattcgctgaaccatcggagtaacgaacattattttttgctaaataataagcatagttgataacaccgataccaagagagcgacgagctaatgaactgcgttttgctgcagcaacagggtagtcttgatagtctaatagggcatctaatgctctgactgcaagatcggctaattcttccaactcgtctaaattttcaagagcacctaagttaaatgcagataatgtgcatagtgcaatttcaccgttttcatcatggaaatgttgcaacggtttggttggcaaggcaatttccaagcataaattagattggcgaattggtgcaaccgcaggatcaaatggcgaatgtgtgttgcaatgatccacattttgaatataaatacgaccggttgacgctcgttcttgcattaataaagaaaatagctcaacggctttgacactgcgtttacgaacagcgggatcttgttcatatttgagataaagcgtttcaaatttattttggtcagcaaaaaatgcttcgtataaccctggaacatctgatgggctaaatagagtaatttcaccccctttaattaagcgttgatacatgagcttattgagttgaactccatagtccatatggcgaacacgattgtcttcaacccctcggttattttttaataccaataaactttcaacttctaagtgccaaattggataatagacagttgccgctcctccacgaacaccaccttgtgagcaagattttaccgcagtttggaaatgtttatagaatggaatgcaaccggtatggaatgcttctccattacgaatcggactgcctaaagcacgaatagcaccggcattaactccaatgcctgcacgttgagaaacgtatttcacgatggctgatgctgttgcattgattgagtcaagactatcaccgcactcaatcagtacacaagaactgaactgacgagtcggggtacgcacacctgccataattggcgtaggcaaagagattttaaaggttgacgtagcatcatagaagcgatgaatgtagtccagacgagtttcttttggatatcttgaaaagagacttgcagcgactaacaaatataagaattgtgcagactcatagatttcacctgttactctattttgtacaagatattttccttccagttgtttcacagcagcataggagaatgtcatatcacgccagtgatcaaggaaaccatccatttcatcccattcttcacgtgtataatctgttaataacgcctgatcatattttcccatccgcacaagtttttttacatgatcataaagttttggcggctcgaaatgtccataggcttttttacgtaaatggaacactgctaaacgagcagctaaatattgatagtcaggactatctttactgataagatctgcggcggctttaataatagtttcatggatatccgaagtgcgaattccttcataaaattgaatatgcgattttaattcgactaaggaaacagaaacattttccagtccttccgccgcccaagtaatgactctgtggattttatctaaatcaataggttctttgtttccgtcacgttttgtgaccatcaatgctttattcataggatttccgagaggttctgatatggttaaaacacaagatatagttataaatcaaaaatgaactacaagataatgggttggacggaaaaattcaagtaataaatttcatctatgattcttgacagaaaataacttacttataaataagtaaaaaatgaaaaagtaataaaaactattatcaaaaattgtgctgtagatcaaaatttatattttttgatataaataaaatgatctttattctttgtggcaataaaaaagccgttcaaagaacagctttcaagggttattttcctaaattatcaaagaatttttttacaccatctaaaaaacctgaggatttagggcgttggagcgttttaccttctaaactttcttccaattttcttagtaactctttttgttcttcgtttagtttaattggtgtttcaataacgatctcgcagattaaatcgccagcatagccgcgagaggtaatgccttttcctcttagacgaagcagtttaccggtttgtgtttcagcaggaattttaactttaagacgaccgtctaaagttggaatttctatttcgccacctaatgcagccatagtaaagctgatagggacttcacaataaagattgttaccatcacgttcaaaaatatggtgtttttttacatgaataactacatataaatcaccggcaggtgcaccatttttacccgctgctcctttacctgctaaacgtaattgattacctgtatctacgcccattggaatggtaacggtaagattttgggttttatgaactctaccttcaccgtgacaggtatgacaaggtttctctatttttttgccagtaccgtgacagtgtggacaagtttgttctgtaacaaagaaactttgttggcgacgaacacgacctgcaccatgacaggttggacaagattcaatttttgaacccgcttccgcccctgagccatgacaagttccacagtgaacaagggtgttaatttgaatatcttttttacagccttttaccgcttcttccaaacttatttcaatatcgtagcgtaaatcctcaccacgaacaacacgttgacgagaacgtccgccaccaaaaatatcgccgaacatatcgccgaaaatatcaccaaagtcagctccgctaaagccgccgaaaccgccggcaccaccaccttgttcaaaagcggcatgaccatattggtcatacattgcccttttctctttatcagccaaaacttcgtatgcttcattaatttctttgaatttttcttcgctttctttatcacctttagttcgatccgggtgatatttcatcgcaaggcgtttgtaagcacgtttgatttctttatcatctgctcctttttgaacacctaatatttcataataatctcgttttgccatgtgtaatccggttagttgttgcgttataaacgctgatagtcatacgttgaaagggcgtattactacgcccttgactctgattagtgagatatacagattatttatcttttacttcttcaaattcagcatcaacaacatcatctccacctttcgtactttgagattgttgtgcaccggcatcagcttgtgcttgttgttgacttgcttgaagtagtttttcggaaacttgaattaatgcttgtacttttgcatcaatttcagttttatcttcaccttttgccgcagtttcaagttcattgaccgcactttcaattggtgctttgtcttcagctgataatttctctccaacttctgctaattgtttgcgggtactatgtactaagtgatccgcttggttacgagcttgaactaactcttcaaatttacgatccgcttctgcattagcttccgcatcacgaaccatttgttgaatttcttcatcacttaaacctgaagatgctttaatcgtgattttttgttctttaccagtacctttatcttttgctgaaacatggataataccatctgcatcaatatcaaaggttacttcaatttgaggcatgccacgtggtgcagggttaataccttcaagattaaattgacctaaagacttattggcagaggcttgtttacgttccccttgaagtacgtgaatagtcaccgcactttgattatcttcagcggttgaaaatacttgcgattttttcgtcggaattgttgtatttttctcaatcaaagttgtcatcacgccacccattgtttcaataccgagtgataatggtgttacgtctaacaataaaacatctttaacatcaccggctaaaacaccgccttgtacagctgcaccaatagcaaccgcttcatctgggttaacgtctctgcgaggctctttaccaaagaattcagctactttctgttgtactaacggcatacgggtttgtccgcccactaaaataacatcattgatttcggaaacacttaaacctgcatcggaaagtgcaactttcacaggctccattgaacgtgcaactaaatcttccactaacgcttctaatttcgcacgagtcaatttaatgtttaaatgtttaggtccagtagcatcagcagtgatataaggtaaattgacatcagtttgttgagcggaagaaagctcaatttttgctttttcaccagcttcttttaaacgttgcattgcaagtggatcgttacgtaaatctacaccttgttcttttttgaactcatcaactaggtagttaattacacggttgtcaaagtcttccccccctaggtgagtatctccgtttgttgctaaaacttcaaacgttttttcgccaccgacttcatcgatttcgataatagataagtcaaatgtaccaccacccaagtcataaacggcaattgtttggttgcctttacctttatctaaaccataagcaagagccgccgctgtcggttcgttaataatacgtttgacttcaagaccggcaatacgtccggcatcttttgttgcttggcgttgtgcgtcattaaaataagccggcactgtgattacagcttctgttactgtttcacctaaaaaatcttccgcagtttttttcatttttttcaacacttcagctgaaatttgcggaggtgccattttttcaccttttactgatacccaagcgtcgccgttatcggctttagtgatttcaaaaggcataatagcaacgtcacgttgtacttcttgatcttcaaagcgacggccaattaaacgtttgatcgcaaataatgtatttttcgggttcgtcacagcctgacgtttcgctggttgtcctactaaggtttcattatcatttgtataagcaataatggatggggttgtgcgttcgccttcagcgttttcaatgacacgtggtttgtcgccgtccattacagccacacaagagtttgttgttcctaagtcaataccaataatttttcccataatatgttttctcctagtatctagtataaattcgttgacagtttcaagattgggataatgattgcaatttcaagtgcatggaatgcaaaattttgaaagtgcggtcattttttgccttgttccgtaaaatgtgattggaaatgaaaaattcaagaggaaaaatgaaattttatgtaaattaagttaaattttgttcaataaattgttgtttttttatttgaatcgcaatttctctccgacgatccagttctgctcgaattgctttatgttgaaagccttctgaaataatctgttgcacatcaacagctaaagctgcttggtagaggcacaacaaaaatttgtattgtgggcaatcggtatagttcatttcggtttgagtaagactatcagcaaggcaaactaacattaattcttcgaagcgttttggtttacgccagacatctaacttattaaataacgttaagattgttttggtgtgcaatgccaaagcatgatgaatatgagaatgatattggcaagttaattctgccagttcttgaacatagttagggactttaaaacgctgacagacatttctgagataagcaatacgtgttattttattatcatgagaataggggggaatattggcggttgagagagcttttcccacatcatgacaaagtgcagcaaaacgtaccgcacttttgtgataatccgttttttcggttaacaatgttgtttgcttaagaatgggcatagcatgcacaaaatcagtcatgtcggagcgatattgtatagagtcggaattaaacacactaatttccggacataaaacttttagggcatctattttttgtaagatagcaaaataaacttgtggatcctgttcatgtagtgctttttctgtttcttgccacactctttccggagaaagttgtctcaactctccattattggctatttttttcattaaggctagcgtatctggtgcaattttaaagcctaattgatgataacgggcggcaaagcgagctactctgagaactcgtaagggatcttctgcaaaagccggcgaaatatgacgtaaaataccttttttcaaatcggcaataccattgtatggatcatgatattgccccgccatatcctgagcaatggcattaatggttaaatcacgacgcatcagatcttgttctaatgtaatattagggttgaaatcacaaataaaaccggtatagccggtacctgatttccgttctgttcgtgcaagtgcatattcttctcttgttttaggatttaagaaaacaggaaagtctttaccaacttgttgataaccctgagagagtaattcttcagctgttgacccaaccacaagccaatcacgatctttaataggtaagccaagtaattgatctcgaacagcaccgccaacaagataaatttgcatcatatcgttaagaccaacgattttggcgacggcgtttcggtattagtagaggtaaaataagaccaagcaataatcctgcacctaaaacagagccaccgtagataaaccactgaatagcgatttctcgtttacccacatctaacatcgcttctaaatcacgatttttattttttgtaatttccaattccctattaaggagtgagttttgttccagtaatttgctgctttgttcttctgcttgtttggtacggcgttgcatctcgcttgttcgttgtttccagtcattgtcaatattattgagttttagagttaactcttggatttgagcttttaattttggattttcttccctactacttggagtactggttaattcacttgttaaaatccatgcttcacgattacgtttgtcacgaattaaggaatatttatcttttttatccagtacggtaaccgactcgcctgcttgaatagttcccgaaattttaaattgatctcctgcacctcgtcgcataaacgttgtgagattttctttcacgtattttgtttcggcataagcgttggataaggaaaatactaatagaagagcggatactaaaagagaggtaatttttttcataataaatccagaaaataaggtcaacaaaaaagtaataaaaagtgcggtagattttaccgcacttttttttgctgacaagtaatgatttattttatctttgagcgttaatgaaaaatcgcataaataatgtaataaatcacaatagcaaagaaagtacccgcaggtaatgtaacaatccaagaagcaacaatattacgaataacggttaagttaattgctgcaataccacgtgcaaaaccaatacctaaaatagcaccaacaagtgtttgagtcgttgatataggtaatccggttcctgatgctaagacaactgttacagcagtggcaaattgggcagcgaaaccacgacttggcgtgaggtctgtaatgcctgtcccgatcgttgacattactttataacccataacaattaaacctactccaatgccgacagagccaagaggcaggatccaccaagccagggtggtttttcctgcaatctcaccaccatgttctatgatggaaacaacggcggacaaaggaccaactgcgttggcaacgtcatttgaaccatgagcaaaagccattgcacaggcagttaatagcattaaaatactaaatactttttcaactgctccaaaggttcctttcgtaacattttgaatgaaacgttggctacgaaaataaaaagaaccaagaatacccgcaataatactaatgataccggatataatcagtgtttctatggtagttaaatgtaatccaatatgttttagccctttcgtcatagttacaatagctaaaataagaacggtcagtcccatataaaaaggtccgtatttttgggcattagctaaaggttttggcgtgtcaaagattaacttttgtgtactaaagaaaatagcgtaagcaataattccggcgagaataggggtgataaaccaacttcccacaatattgcgtacagttccccaatcaactgcatgtgcaccgacagtaatacaagcaaaaccgacaattgcaccgataattgcatgagttgtagaaaccggccaacccatttttgaggcaattaataaccaaatccccgatgaaaaaagagctgccatcataccgaaaaccaaaatttccggagtatcagtaaactgcattggatctataacgccgcttttaatcgtttctgttacttctcctcctgcgaggtaagctcccgcacattcaaaaaacatcgcaataaaaattgcttgttttgctgtaatagtacctgaacctactgatgtccccatggcatttgctacatcattagcacccacaccaaatgccatcaaaaaaccgaaaacggcggtaataataacaagtatagttccgtattcttgtaaaatttccatagttgatcactcctatgtatttatcgttatgaacgagctaacattaattcaattcgtgaacccacacgttgtgcttgatcagctaaaaccccaatccatgctaaagtttcatataaaaacatcacatcaataggactgtactgattttctatgtttcggagcatcatacgaagtttgatttgcatatgatctgtatcatcttcaatggcatccaactcatggattaggttattgacgagagtcagttcatgtcctttaaatccggtttccaataacgcatccatttcctcaatcacacgatttgcttgaactgtcgcatctaaactacgataaacatatttcataaaatcctcttgcatttcttgaggaaaggtaaattggcgaccgagcattctcccagctatatctttggcacaattcgctaatttatcttgttgagttgtcaactctaataaatctgtacgatcaattggcataaaaagacctaaagggagcttcaagcgaatttcacgtttcagtgtgtcggcttgacgttcaagttctgagagctcagcacggatttttgttgcattatgccaatctccggcaaaggtactttcaaagaaaggaatgagtagtttacaacattcagttactttatcagaatgacgctgtaatggcgttagaggtgaatgggcaaataatcctagaatattattcattgccatatgaattgaactccttagtggatttgataaaaaattcaggcgcatattaccttatgcgaacagaaaaatatagaaatttcatcgaaaaaaataggtttttagtagataatacaggaacgcatttcttagcaaggaaaggaaaatgaccaaagaaatagagcttaaattgagtgtatcaaatgcctttgctcaatttttaagtcaagaaatgacaagttttcatgtgttaaaacaagagaaggtttttttaggcaatacctattatgatacagcggacagttattttgctcggcacaaaatgggcttgcgtgttcgtcaatataataatgattttactttaaccttgaaaacaaacggtgatgtgctgggtgggttacattctcgccctgaatacaatgtatctcaagaaagtgcggtgccaaatttggcgaaattaacagaaatatatgacttaccgaattggcatgaatttgtcttacagcctattttccgcactgattttgagcgttgtttatggttggtagaatgtgggtatgatgtggaaattgaagtggctttagatcaaggctggattattgcaggagaaaaatccgttcctatttgtgaagtggaatttgaattaaagcagggaaaaacagaggatttgttaaattttgtggcaaatttatctttagaaagtgatgttcgcttaagttcagccagcaaggcacagcgaggttaccaattggcatttaatatacaacctcaaattcaggattggatcgcaaaatggcgtgagtttattgtcttagcagcacatgaaaagatcgcttatttagtaaaatttgaacagcaattaatcgaagaaagtgtgatgctgggaaaagattattttgcacaagaatttttgcgtacagtggagcgaatcggtgcattttttaatctatatcacttttatagtgagaacgtaacgttattggaaaatcaagtaaatcttcaattgacgcaaggcatcactcatttggatcagaatttgcttgctgatcttgttgaacgtaatgcttatttattgttgcaaattaaagacattattcggtgtcatagtgaaaataaaaataatgcacttgcgattgaaaaattatttgcattatttcatagcggtcagtatgtcaaacgtatgttagatttaacgtttttaacactttaaggatacagcatggcaaaatcacccaaaacagcctacgtgtgtaatgactgcggtgcggagtttgcccgttggcaaggacagtgttctgcatgtaaagcatggaatacgattagcgaagtgcggttagtttctacagcaaaagtgaaaaatgatcgttttagcggatatgcaggagaagcgaaagccaaaattcaaactttagctgaaatcagtttgcaagaaacgcctcgttttaccagtggttttagagaattagatcgtgtattggggggcggaattgtgccgggtagtgcgattttaatcggtgggcatcccggtgcaggaaaaagtaccctactgttacaagtgatgtgcggacttgctcaaagtatgaccgcactttatatcacgggcgaagaaagccttcaacaagttgctatgcgagctaatcgtttaggattgccaacggatcgtttgcaactcctatctgaaacctcaattgaacaaatttgtcatcttgctgatcaactaaagccgcaaattatcgttattgactctattcaggtaatgcatttatctgatattcaatcttcccccggaagtgtagctcaagtgcgtgaatgtgcggcatttttgacccgttatgctaagacaaggcaagttgccattatcatggttggtcatgtaacgaaagacggaacgttggcagggccaaaggtattagaacatgcaattgatgcatctttattgttagaaggtgaatccgattcacgctatcgcactttgcgtagtcataagaatcgttttggtgcggtgaatgaattgggtgtttttgcgatgacagagcaaggtttgagagaggttaaaaatccttctgcgatttttttaagtcgtggtgatgaacaaacgtcaggaagttccgtgatggtagtatgggaaggaactcgtcctttattggttgaaattcaagcacttgtcgatcattccatgttagccaatccaagacgtgttgcagtaggtttagaacataatcgattagcattgcttctagcggtattacatcgtcatggcggtttacaaatgtccgatcaagatatttttgttaatgttgttggcggggtaaaagtaacggaaaccagtgccgatcttgccttattgctggcattaatttccagctttcgtaatcgacctttgccacaagatttagtcgtgttcggcgaggtaggtttagcaggggaaattcgccctgtaccaagtggacaggaacgtattagtgaagcagcaaagcacggttttaagcgagctattgttccctttgcaaataaaccgaaaagtgcggtcgaaaatatgcaagtttttacagtcaagaaattagcggatgcattggcgatattagataatttttaacaaaattgccggataaaaacgaataaatatctaaaaaatagtgtaaaattagacaaaaataaatattttatgcggaatttctatataaaaagggatgaataatggaaaagaagattaaatcacttgatagtattgatataaaaattcttaatgaattacaacgcaacggaaaaatttctaatattgatttatccaaaaaagtgggattatcgccgacgccttgtttggagcgggtaaaacgtttagaacgccaaggcattattatggggtatcgtgctttattaaaccctgaattattggattcgcctttgttggttattgtggaaattacattagttcgtggtcgccccgacgtgtttgaggaatttaatgtggcagtgcaacaattagatgaaattcaggaatgtcacttggtttccggagattttgattatttgttgaaaactcgtgtagcggatatggcagcgtatcgcaaattgctcggcacaactttattacgtttaccgggggtaaatgacacacggacttatgtagtgatggaagaagttaaacaaactaattttttacaattgaaataagatgattaaacgtattaaacaattttttttaccgaaaagggatttagtcgagtttttattaattctcaccgcactttggggcttttatttgatcgttgcttggtttagctatagcccgtttgataattcgtgggcgatatcttcttttcaaacggaaactattaataaagcaggtgcattgggtgcttggatgattgatctgtttttcacgttttttggcgttgtaggtaatatcataccgtttgtactatttatcgcacctatttattttttacatactaagcgaactcaagggttaacttggggaagattttttcttcggatattgggttttgtgacattgctggttggtttaatgatcttggctactttaatgttggtaaaaactgaacatcatttatcgggcggtgtattaggtgctattttaatcgttaagttatatccgctattttctaaccaatttcccttaattattattggtagcattgcttctataatcggttttattttctgttcgggggcatctttattttatttaatgatgaattgttacgactggctgacaatgaaagataaagaatctctattggatacacaatcgaatggtgctgattcagttgaacaggaattggaagaaattatcatacaatcgccacctatagaacaaaatatcgccaatgaagatactgaaaaacaaggacttgagttagtgaatattagtagttttattaatattcaagggttacctgatgagcaagtggaagaacagcaaaatttagcagctccgatgttgatgaagcaaaatgaagtggttgatattgctcaaacactaggcgatttaaagcaacaagaattgcctattccaagcgtttcattgtcaacagaaaaaaatgaagcgttagctttggaaacagaaaatattgcagaacagaccgcactttctgccgttgaggaagctgacaatcacaatataaatgaacttgccaaacaatttgctgaatttgagcaacaacgtttattgaaaatggaacaacaggcaagagaaatcggagcagaggatgcgttaaaagtgattttagctgaagaagttactgaagacgtgccggcggttatggaagaagttattgaagaaaaagaactcagtcaaagtgcggttaattataagacttatggcgatagtttgattcaccccgcattacagcagaaagtgactgttcaggaaaaaccgacaacaccattgccaagtttagatttacttgaacgccgaacgatccaaacttataacattacccaagaggaaattttagaaacatctcaacgtattatgcaacagttacgtaattttaatgtaaaagcggaagtgcgtgatgtactcgttggtcctgtggtaacacgttatgaattagaattacagccgggagtaaaagcttcaaaagtgacaagtattgatactgatttggcaagggctttaatgtttcgttcaattcgtattgccgaagtgattccgggaaaaccttatattggaattgaaacaccgaatatacagcgtcaaattgtacctttgcgtgatgtattggatacggatgagtttcggcaatcaaattatttattaccaatggcgttaggcaaggatattagcggtaagcctgtgattgtagatttagcgaaaatgccacatttattagttgcaggatctaccggttcgggtaagtctgtcggtgtgaataccatgattttaagtttacttttccgtgttaaaccggaagaggttaaatttattatgattgatcctaaagtagtggaattatctgtctataacggcattcctcatttacttacggaggttgttacggatatgaaaaaagcagctaatgccttgcgttggtgtgttgacgaaatggaacgtcgctaccaattgttatcagccttaagagtgcgtaatattgaaggatataacgaaaaaattacagaatatgaagcgttaaatatgccaattccaaatccactttggagaccgggtgatacgatggacactttacccccaccattggaaaaattaagttatatcgtacttattgttgatgaatttgcagacttaatgatggttgcgggtaaacaggttgaagaacttattgctcgtctagcacaaaaagcacgagctattggtattcatctgattttggctacacaacgtccatcagtagatgtgattactggtttaattaaagccaatattccaagtcgtattgcttttactgtagcgagtaaaattgattcaagaaccattttggatcaaggtggtgcagaggcattattaggacgtggtgatatgctgtattctgcacaaggatcatctgagttgttacgtgtacatggtgcttttatgagcgatgatgaagttgtacgtgttgctgatgattggcgtgctagaggcaaaccgagttatattgaaggtattttggacagtgtgaatgacgaaagtaatgataatgaaactgactatgacagcaatggtgatctggatgatctatttgatgaagttgtggaatttgtcataaacaccggcatcacatcggcatcttcagttcaacgtcgtttccgtgttggatttaatcgagctgctcgtatcatggatcaactggaagaacaaggtatcgtttctccgctacaaaatggtaagcgggaagtattagcgaggaaaggggattactaaattaacattgcgatataatttgtgcaaaaaaccaccgcacttaattagtgcggtggttttttctttgggtgtagcaagttggctaaattaccactgataccccacaccaaccgaaccgccgacatcgcccgttgaactgcgagtaccttgcaatcgtagcgttattttaccattatcacttactcgtgaataacctaacgccagtgcattttgtcctttaaatgttccggcagatgccgcaaacatggatttacccggcacagaagacatcggcaacccagccgccgccaacgctcctgcaattcctgcacgtaaatttcggtcagtagtattcaattgtgtccgcagttcattgtctttggtgtccacatagtttttattagcaattgccatacctgaactggaagtgttcaaatcggaaaccaatgcttcacctttggcatttatgctgattaccgatttttcacccagtcttaacgcacgagacttgccgtctaaattcagtcctaacttatcattttcatagaacgccaagcgattttcgtttaattgggatcgctcttttgtacttgtgttttccacattcaacccattgctatccaagcgagattttttgccattgatttcacgggtttcaaaagaggtcatgtttttcaattggtcggacagtttgacttctaagcctttaccgtcttgagacatttccactttgatattaccggcagcggtgcggtcgctgttaaatttattgccattcgcaccttcttcacctttaatcgccaaagtaccgcttaatgctgtgcgaatttccatgtcatcattgcctttaaatttcaagcccgatttcgccaccgcctgcaaatcaccgattgttgccacgttggttaactctgcggaactatcaggtttcactaactctacaactttctcatagcctttgtaattttgttcataggcttcctccgcttttgttaagcctgtttgagcttcttttaaatcatttcttgcttgttcaagtgcttttttcgcttcatcaagtttcatttgattttctttgagcttggcttctgcttgtgttttatcattgccttctggcaacgcatttattgcttgttctaagctacttaccgctaatgctaaatccgtgaaagtttgtgctttgtccgaaagtgctttagcttyctygcycacygctttyactttttcctcaacagctttggtgagttcagycgmtttttcttgagtctttttcttctcttcttcggtttgtgcttctarsccaagaccactygccacattgctaatcccaataggygyggygstnggytcggctttgatcacgacttgtttcttctcttcctcagaaatatcttgaagtgtgccgtcttttaattttttgaaactaccgtcttttcctttcacgactttttccttgcctaaataaaaatcaaatggacggttattgttcagatnnnnnnnnnnnnnnnnnnnnnnnnnnnnnnnnnnnnnnnnnnnnnnnnnnnnnnnnnnnnnnnnnnnnnnnagaccggtaattttgcctgagccgattttcttaccgtcagtatcttttgtggagaacgcaatagatggaccttgatctttctcaaacgattctagactgtttttatccactggttttgcacctgctttaataatgattgatggtgtttcagcaaatggatttgctccatttgctccgcctgtgttattcgccccttgtggggtaagtgtaataccctctttattgatattcactttcgcacccgttgtgccaacttggaatgtggcannnnnnnnnnnnnnnnnnnnnnnnnnnnnnnnnnnnnnnnnnnnnnnnnnnnnnnnnnnnnnnnnnnntttaggtgaagagatagattttatattttctaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccattctcatacatttgtttttgagaaagcataaccttttcaaacatcggtgcgtctttaaacccgatttcgattttggcgttgccgttagtttcgctcgtgtattgagtgattaaattatcacctttaaactcagcaatatttggttgtgatgaagtccccgccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcccttgttaatagccgtaatgctttcattaatagcttctctaaannnnnnnnnnnnnnnnnnnnnnnnnnnnnnnnnnnnnnnnnnnnnnnnnnnnnnnnnnnnnnnnnnnnnnnnnnnnnnnaaagttgattgtttaaagccatcatctgtatcatgtttctctgcaccaagtacatcaaaacctaatttaccaaaaatgctaatcacttccgcaagctgtccgccgttgatggcatcggttgagcctgtttcgactttacctgcggcaacgttggtgataatccgctcgctacccttatcccctacactgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttccccaacgcaatggaatcgcctgcattttcttcaactgtcgcactttccccaatcgccaccgcacctgtggcgttttgcttaacattcgcacctttaccgagtaccaccgcactttgtgctttggactctgcttctctaccaatcaccacggaattacttgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgcggtgctttccgcccccttaattgtcaaggttgannnnnnnnnnnnnnnnnnnnnnnnnnnnnnnnnnnnnnnnnnnntatcgcccttgaattttaagcccttgttgatggtttcaatgcttttctcaatggcttctttgaatgtcgttgcagctggagatgtctcacttccattttcatttttcaacttggtaaatgtggttgctttgaattgttttgtaccgctatccacttccgcacctaatactgtaacgcctaatttaccaaatgtttcaatcacgctatacaactgtccgccgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctttaccgtcctcaagtttcaatgcccccttgccatcagctttgttaatttcagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttttaaggtctcgccgagttttctggtgacatcttgagcgtcatttccttggaacttcagccctttttccacaatcgctttcgccacttcggataagtcttttacattaatggcattgttggaaattttgttgccgttgttattacctttatcaggattgccagtaagaacgttggcaataactgtactattattttcggcatttccaccagtaccgctagtatctgtcaatcctaaaccgctcgcaagtgcggtgatttttttattaccaacatggaatccttttggatcaaaggtgtagctcgcaccatttgaaagaatgacaacattggtattcgcattattgcctttactattttcattaaacttaatttcagtttttacttttgtgccaccattaccgccattggcgacctccttaccggcaatcgaagcaatctcttttaatgcctcattgacattaaacttaacaacaccgttactttccactacagcggttgtgtttgtaccatctttaaaattcaaaccatcgcttaatttgacggtataatcacccgaaccattcgccttgtatttaatgacttggtcggtaatttttccctctatactggtttttactgctgtaatagctttctcgtttttatccgctttagtagccgtatcatcaatttttttcgtgattttctcatctagcccaattttgatcgtatcttcaccctcaacagaggttttaatttgattagcagtgcctttcactttcaaagtacccgtttttaatggtaaggttttttcaccaccactgtctgcttggaattttaagttagagctgagattattaactttatcatcaacatattttttagtggttaannnnnnnnnnnnnnnnnnnnnnnnaacatctttagttactgtgactttttcaaaacgtggatcttttttaattccaattaggaatactccttgatccttaccgtaattcgttttgatgttatcgctggcgaaatcaccgccgtcaatattgccggcttgtatnnnnnnnnnnnnnnnnnnnnnnnnnnnnnnnnnnnnnnnnnnnnnnnnnnnnntaaagcctatattaattttatcaatattatcatctatcgcttgtttaaatgttttttgtatagctggtgttgaagcagtggctccgttagaacctattaattgattgaatgttgatttcgtaaatccacctgaatttactgtcgcacccaatacagttgttgctaactcttgtaattgtccaaagttggcagcatctttgtcggctattccttttgctaactgggtaatttttttgttgcctaagtccaagccatctctttttaatgttatcgttgaaccgctttttgacgagagtttaagaccatcactgttcgtaaagtcaattttattgccactattgccatttttaccggcaatagaagaaatacctgttaaagtgtctttaagcgatatggtaaccgcactaccgctagcgtttgtcttgatattgccattatctcctttaatatccagtttgctagttactttaaaggttccgttatccccatttacattaaaactggtagcaacatttttgaatttatcatcaacgtattttttgttgacggcatgcttgtcatctgtagggttaccggtaagttttacagtcttaaattcaggatcgtcttttaagccgatagtaaatgttggttttgaactatcgtttttaaattctgtttttaggtttttacccagatgtgtggctttaccgccggattgaatatttccagctttgattacaatggttgaacctaaataaaaaggtgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaccaatatattcaacagcggtaaaattatgactattaaattctgttttagcattgttagccgtcaatcctaagatactaccaccaagctgattcagctgattccctgtaatcgcttgatccgagttttgtgcaattttgccgtcttttaaattgccgaattgtattttgttcccaagatctttggygcctattttttcatcgaaaccttttgctccgactaatactttgtcctcggaaattgcctgagaatcttttaacggttcgcctgtttgggtatcgactttgtagaattttttgtcatcagccgattttactagcttcactttcttgccgccttcttcggtgtagtaaacaacaagtccttcttttttaacataatataacgctcttagttgtcctacagtggcggcatcactatccaacgcgcccggtgcgacattcactattctacgcaatccaacatgatttttatttcctttagatgaaccgggaccgccctttgcatcttttgttgtatcccaacccccaacggaaataacccctgccgatgtatccgtttcaattctataactggaaccttccggtacatatccttctaaattggaggcattgtaggcatttttttcatttaaactggctgttgttttatctgtatcattataaaagtaattcgtcgttgatctatatcctaaggcgactgaattttcggatgatgagcttgaattattccccaatgcgactgagtttttagcattttcattaatcttagaatcattccctagtgccatagaggattctgaaagagaagacgaaccatatcctatggcaattgaattatctttcttaatcccaactccggatcctatcccaattgctctcgcacctatgacggttacccccgttcctattgcaaccgagttttctttatgtacgtttgttcccacacctatggctattgtattggttgcatattttccaacattatttaacgcccctaagacgaccgaattagctccccttacataagaggcactacctatggctatggtattatctccattatttgaaatgtgataacccaaggatattgcatgatctccttgttttttcgttttctttatatcttctgttgtggtgatttctacatgattttctttttcatatgtaaatttattttctttttcaagtttagttataaagtcgcttattttattctgtccattaaaatgattggcaggaaatccatacttaacaatttcattgtgatctcccactttaagatcattaatatcagtagttacagttttcaaccaaggatcttgattttcagtcacattaccaaggttggtttcttgcataatttgagctctgaatttctcagctgatgtatgcgttaattctgcattcgaagacacattaggtcctatcgctattgaacccattcccactgcttttgctccggaaccaaaggataatgatccttctgcggttgattcagccgcatttcctatggcataagaatttttcgcaaaaacccttgatgagtcacctattgctgttgctccgtcagcacctaaaccgacaaacgcacgaacaccgaccgccgttgctctatcggctaatgcaaatgataacgtccccatagccagtgaagcatttccatatccaactgatcttgaccctattgcgattgcccccactccggctgcataggttggggaatatattctgtgatcttcaccagaatctgacctaatatattttttgtaaaaatcgctctcatttactaaatccttataagtaacgttactagatgctctatttccattatatccataaattagttttatagtctcttcaggtagcctatcttcaaatcccccaagtcctgctttaatattatttgctccaaaggtaccttttttcccatttgcaaatatatcatcactacctattgcgatagatgattctccagccgccatgacgtccgcacctaaggctgtcccttgtgctgctgcataaacattatttcctattgccgttgcttgagcactttgagctttacttcctttccctacagctgttccatyttctcctgctactgcagcttcatagcctacggctgttgctccatctcgaagtgcttgagctccgtatcctacagcaaccagtccttctcctgttgctttagttttatctcctgcccctattactacaactttttccaacttggtgacttgtccacttactctatgtaggtcttttttccctaacacaatattaccattattattattttctccatattcattgcgccaacttgctatacctacagttcctttactttcattaatagctaaccaagcagcatttgatatagtactcacccctaaaaagcctgctatcataaaagccaacggtaaaaccttaaacgttcgtaaaagcccaccgcactttggtttctccgagctgctcgccacttggcgattgcttgccaactcggaaacggctttacattgacctgttgtaatatcgtatttggttttaaatattttgttcatagaattactcgctttaaaaattatctttgaatgacttgttaaatggttattgatcgaatctgttattgattgtttatttattatctcttactgattatttattaaactttagagagaggggataaccctaaataggcaataccttgctttttaaggcatagcagaaaaaggcgaatgatattttcgcaaaggggtttaaaaggggaaatttgggtatgacgagaagttaaaaaatttttaaaatttattttgcaaggtttataaaaaggcgttagcctaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctcatattgttttcgtctatcaaatggttaagtaataaatttgggcgattttatcccaaatttattagtaagggaatgatttcgtgtattttatttgtattttacacttgttgttgattgtttacgatttgcaaccatgatttccacaacaaccgtgatgttcatggtgttcatgatgatgtccgccacatccacaatgatgaccctcttcatcattatcatgtgtacaacaaccgccctctgtatgaatatgaccatgtgccatttcttccagtgttgcttcacgcgttgcaatgacctctacggaaaaatgcaattcttgaccggcaagcatatggttaccatcaactaccacctcattttcatttacttcagtgataacaacaggtaatggcccaagatccgtatctgcgataaaacgcataccgactaccagctcatcaacgcccacaaaaatatctttgggtacacgttgcaccatgttttcattatattctccgtacccttcttccggttttacacgcacttcgaatttatcaccgacagatttaccttccagtgcattctccagtccgatcacgaggttctgatgtccatgtaaatattctaaaggttgatttgccggtgcttcatcaaccaatacgccgtcttcagtgcgtacttggtaagcgatacttaccacaacatttttttctactttcatttttattcctttatgctgtaaaagtgcggtcattttagccaaaatattggctattgtcattcatcttcatttggatattcgtcaaaaaattctccgtcattaccatattcatcttctgttgcattcggatcttcgaagtaagtaccccatccgtcataaatgccaccgaattttgtgattaatggcaataagtctttttgttgtgcatcaatgatttctgcttttaaattaacttcactaatgatgtcaaagcagaaaatagatttaccttgttcatcttcaaattcttccgcttcagaaacttcatagcctgctttgaaagcatcaacggcgattttttctaacttatcaaaatcgtcatgtgcgatatgatgttcaataatatataaagcatcaggatcactaccgtcattgagtaaatcagtaataatttttctagtttcttcttggagatctacaagtgcagtcatattttttcctttatgtttatttagggagtggggataaattcattgcgttgatataatttaattgtcgccatgcttcatagacggtaaccgcaacagcattggataaattcatgctacggctattttctatcattggaatacgaattttttgtgttgtcggtaagttatctaaaattgacattgggatacctctagtttccggaccgaacataagataatcgcccaactcaaaatttacttggctatgtgcaggtgtaccttttgttgtgagtgcaaaaagacggttaggttgttctgtgtttagaaattcattaaaagttttatgctttttgatttgtgcaaattcatgataatccaaacctgaacggcgtaattttttatcgtcccaagtaaatcctaagggttcgattaaatgtaaacgaaaacccgtattggcacataggcgaataatatttcccgtattttggggaatttccggttcatacagtacgatgtctaacataacaaaatcctcgtttatgcaacatggggaattttactcttttatcaactaatcacaaaattattcctaccgtttccttcaaaaaatacttctaagcaaacagaaagtgcggtctaaatgtgcataaaaaaggcggagaactctccgcctttcatgatggaaaatatattattaagctttaggaccagctgcgatgagtgcttttccttcttcatttgtagcatatttttcaaagtttttcacgaaacgacttgcaaggtcttccgcttttgcttgccattgtgctttatccgcataagtatcacgaggatctaagattgcaggatctacacccggcaatgcttttggaatagctaaatcgaagattggtaatgaacccatttccgcactttcaattgagccgtctaagatagcgtcgataataccacgagtatctttaattgagatgcgtttacctgtaccgttccaacctgtattgactaagtacgcttcagcaccagaatctttcatacgttttaccaacacttctgcgtattgggttgggtgcaaacttaagaatgctgcaccgaaacaggcggagaatgttggcgtcggctcagtaatgccacgctctgtaccagctaattttgcagtgaaaccggataagaagtagtatttagtttgttcaggtgtgagttttgaaaccggaggtaagacaccgaacgcatctgccgttaagaagataacttttgttgcatgtcctgcttttgataccggtttaacaatattgtcaatgtggtaaattggataagatacacgagtattctccgtttttgaaccgtcatcaaagtcaacggaaccatcctcacaaacgacaacattttctaacaacgcatcacgtctgattgcacgataaatatcaggctcgctttctgcggaaagtttgattgtttttgcataacaaccaccttcatagttgaagacaccgtcatcatcccagccatgttcatcatcaccgattaattgacgtttcggatcggttgaaagcgttgttttacctgtaccggataggccgaagaaaatcgccacatcgccatctttgcccacgtttgcagaacagtgcattgaggcgataccttttaatggtaagaagtagttcatcattgagaacatcccttttttcatttcaccgccgtaccaagttccgccgattaattgaatgccctcagtaatgttaaatgccacaaagttctctgaatttaatccttgctctttccaattcgggttagttactttagaaccgttcataaccgtaaagtccggtttgaaattttgcaattcttcatcagacggacgaataaacatattttttacaaaatgtgcctgccatgcaacttcagtaacaatacgcactgctaaacgtgtatcagggtttgctccgcaaaaagcgtcgataacaaacaaacgcttgccggaaagctgtttagtgaccaaccctttcaaactttgccaagtttcttggttcatcggcttattgtcgtttttcgccgcatcgctcgtccaccataccgtattttttgttttttcatctaaaacaatgtacttatcttttggcgaacgaccggtaaaaattcccgtatctaccgcaaccgcacctgaagtggtaacaacacctttctcgaagcccgctaaacccggtttagtttcttcttcaaaaagttgttcataactcggattatggacaatctcttttacatcatagatgcctaattcacctaattcatttattactttgtttaagtcagtcataaaacacctcatagttaaaagttaattttaaaagttaatcatttagtggtagacattatagtgaaaataagaaataaaaaatgttatcttgatctcaaaattgaaaaataaatgaaatgaatgttgagaattataaaaagcgatggttgaaccatcgctttgaattaagattaatatgattatggataaacaggaagacgtttgcaaattgctaacactttttctttagtattagcaatgacttgttcatggttatttttattcatactgtccaaaatatcgcacatccaaccggcaagttccgccacatcttcttcgttgaagcctcgacgagttacagcaggcgttcccacacgaatacctgaagtaacgaacggtttttgcggatcattaggaaccgcatttttattaacagtaatattggcacgacttaacgccgcatcagccgctttaccggttaagccatgattgactaaatcaactaagaataaatggttttctgtaccgttagagacaacgttgtaaccacgttgtttaaaaacttctaccatagcttttgcattttttactacttgtgcttgataagttttgaactcaggttccaaagcttctttaaaacaaacggctttcgctgcaataacatgaactaacggtccgccttgtcctgccggaaataccgcactatttaattttttgtaaagttcttcattgccgttggcaagaattaaccctccacgaggtcccgctaaggttttgtgtgttgtggtggtaactacatgagcatgtggcattgggcttggatatacaccggcggcaataagccctgcaacatgtgccatatcaacaaataaatatgcacctacttcatcggcaatttcacgcatttttgcccagtcaacgatttgagaataggcagaaaatccgccgacgatcattttcggtttcacttcatgagcctgtttacgcaacgcatcatagtcaatcagtccttcggatgtaataccgtattgctccgctttataaattttaccggagaaactgaccgaggcaccgtgagttaaatgtcccccatgagcaaggctcattcctaaaatggtgtcccccggatttaataatgccatataaaccgccgcatttgcttgtgagccggagtgcggttgaacgttagcataatctgcaccaaacaacgcttttgcccgatcaatcgctaattgttcaacaatatctgcatattcacaaccgccataataacgtttacccggatagccttctgcatatttattggtgaattgacaaccttgtgcttccattactcgtgggctggcatagttttctgaggcaattagctcaatatgctcttcttgacgaagattttcatcttgaatggcttgccataaaaccggatcgtaatcggcaatattcatacttctttttaacattatgttttcctctttgctcacttatgaaatggtaacagtttacctgttttaacttaaaaatttaattaaaaattaattcctatttttcatcggtgtaatgaaaaaatttcattcataaataccgataagattgaccgcacttttattgattttctcttgctacggcacgataaccaatatcttgccgataaaaacgtccgctccattggatttgtttcgccaattttaatgcttgctgttgtgcggcaaagacattttcacccatcgctgttacacaaagcacacgccctccattcgtcaataatcgctctcctttttgctcaactccagctaaaaaaactttttgattttcacccgcacttattggcaagccttgaatttcatcgcctttgcgatagctattcggatagccttctgcggctaaaacaataccaagtgccgcttgttcagaccattcagatttcacttgatccaatttaccctcgcaggcatttaaacaaagctcaaccaaatcagaccgcatacgcatcataatcggttgggtttcagggtcgccaaaacgacagttaaattcaattactttaggctgtccgtgtttatcaatcattaaaccggcatataagaaacctgtataaatattgccttctttcgccatgccattcacggtaggataaatgatctgttgcataattcgcgtatgaatttccggtgtcactacaggtgccggagaatacgcccccattcccccggtattcgggcccgtatcattttcaccaacacgtttatgatcttgtgaagtcgccatcggctctacatttttaccgtctaccataacaataaaactggcttcttcaccctctaaaaattcctcaatcactactttgctaccagctttgccaaaagcattaccggaaagcatatcttgaatagctttttccgcctcagccaacgtcattgcaacaatcacacctttgcctgtagccaaaccgtctgctttaacaacaatcggtgcatctttttcacgcacataagcaatcgctttttctgcatcagtaaaactgcggtattcagcagtaggaatatgatggcgagcaagaaaatctttcgtaaatgcctttgagccttctaattgagccgccgcttgagttggaccaaagatttttaaccctgatgctcgaaaagcatcgaccacaccaagcactaaaggtgcttcaggtcccacgatagtcaagccaatttgattttcttgtgcaaagttgaccagtgcatcaatatcagtagcggaaatagctacattttccaccgcacattttccgtctgtttccatagctgtccccgcattgccgggtgcaacaaatattttgcttgctaaaggtgattgtgcgactttccacaccaaagcatgttcacgtccaccatttccgataattaaaatattcattgtttttccttccttaactgttttttaggaataaagaaagcgggaggcgtattttccttaatatttaaataccctgaatctcccgttagaattgaatgattaattgtaccatccctacaatcagatatatccatatcataactcatgatgttaattaaaaatgtagccagttgctgatgaaacatttttttacaagatgaaaaatggttatgaaaaatatcttgtaaaaacttattttcagaataaataaaaataggcactaaataattagcttcatttaatgttccttgattatatacttcattagaaacaaactgtccgtgatcggaagtataaattaaaacccaatcttcaggttttaaagatgttttaagataattaaacactttttcaattaatttatccgtattatatatagtactatcatatttatctaaaggggtgttctctttgaaaactttttcttgctcagataaataataagcatagggtgtatgagatcctctttggtgtaaaacaacgaaatgcttcttacccccccccacctcacttaaatctatattttccagtaatggaaataagttatgatcatgcattccttcagaagatttatacccaaggctattaggaaaacgcaaatcatcgacccacgttttacccataagactcataatcatcatttgattttcaggttgtgaagaatagaaatatgtttcatatccctgctctttagctaagcggaataagttagttcttccgctaacaatttgttctaacccatttggttttggaatggcattaaacaatgatgggagagaaatagcagtccttgagcctgctgaatatgcaggttttaataatgtttcagtaggaaaattttttgataaagatgttaagaatggggtggtttctctctcataccccaatgcacttacattatttgcacttacactttctcccataatccaaataatattaggtatttggaatgagaatttaggtttcggcttcggcttatctttgtaataaaccgatacgttgctcaaattaaataaatcatagggtaaagttctacctataaaatatccaaaagaaaaataatttgctttaattcttgagtagcccggattggaagtaattcccagttcttgatcagaataaaaactacgaataaaaatataagccatacttaataggaataaaatatctgcaattaaatatgttttttttctaaatcttgaaatagaagaaaaaataagaatatcaaaaacaccccaaattatccctccggatattttatccaacatatgaataccggcatttgtaacttcccaatattctttaaacattaataaataatttgtaccattaatccagctttgatagacctcataatgaacattattaactaacgtactacaagaaaaaaataacaaaataataaaacgagttatcttatattttgagaaataaaataatgaaattaaaataaatattattagaaaactctcactaattttgtataaactatttattccaaaaaaatagcgataaagtatttcactaattaataaaacagcagaataactcaacaaaacaatgatatttttcatgaaaatccttatttattaatgtctaaaatgacgcattttagtgagtaccattaccatattatgctcattggcggcatcgataacttcttgatcacgcattgaaccgcccggatggattacgcattcaataccaacttttgcggctgcatcaatgccatcacggaacggaaagaaagcatccgatgccattacacagccttttacttccaaaccttcatcttttgctttgatccctgcaattttcgctgaataaacacggctcatttgtccggcaccaatccctacagtttgattatttttagcgtatacaatagcgttggatttcacaaattttgccactttccaacagaataaaagatcttccaactcttgtttggtcggttgacgtttactgactacttcaagatctgctaaatccaccatagataaatcagcctcttgtaccaacaaaccgccattgacacgtttaaaatccaagcgttgtattgcactttcccaattgccacacatcaataagcgaacatttttcttacttttcacaatttcttgggcggcggaactgacggtcggtgcaatgatcacttcaacgaattgccgctcaataatggcttttgccgtgtcttcatctaactcacgattaaatgcaataattccaccgaaagctgaggttggatccgtttggtaagctcgattataggcttcgagaatatccttgcccagtgctacaccgcaagggttagcatgcttaacaataacacaagccggctcggaaaaagattttacgcattcaagtgcggcatcggtatcggcaatattattataagaaagtgatttaccttgtaattgtttggcggttgagacacttgcttcttttacatcttgttctacatagaatgctgctttttgatgaccgttttcaccataacgcatagattgtttacgtataaaattaagatttaaagttcgtggaaattgaccgcacttcgcttcagcttcttcttcagctctgaaataaggttttaccatttgtccgaaataattggcgatcatgctgtcatattgtgcggtatgttcaaacgctttaatggctaaatcaaatcttgtctctaatgttaaactatttcgattttgatccatttcagcaagaattgcattaaaatcgccattattgactacaatagccacatgttgatgattttttgcggcagaacgtaccattgtcggaccgccaatatcaatgttttctactgcatcttcaagtgtgcaatcaggttttgctacagttgccgcaaaaggatataagttcactacaaccatatcaatagcatcaatttgatgttgcatcataacttcatcatctataccacggcgacctaaaatgcccccatgaattttaggatgcaaggtttttacacgtccctccatcatttcaggaaaacctgtataatcagatacttccgtaacaggaaccccgttttcagcgagtaattttgccgtcccccctgttgataatagttttacacctcgtttaactaaaccttgtgcaaattcaacaattcctgatttatctgaaacgctgagtaatgcttgacgaataggatgatttaattgcattgaatatttcctttattttaaccgacaaaaaacgcaggcattataacgcaaacgtttgctcttgtgtaaataaaaaagcctataattaagtacagaatgaatacatgtagcggtaaaattatttttccactgctttatatacgcactaaaataccctgacattttttgcaaaaatataccgcacttttttgttgaatgttgtgatgacgacgtgcggacaattgatgggtttgacattgacattgataagtaaacgttttgcctcttacattcgttacatcaaactgatgacacgtatccgccggaagctgaaaaatcttgttcatcacatgttgccattctgagccgtgaggttttacacgcccgaattgttgatacacaattaaatgtgccaactcatgaggaactacttgctgaataaattgttgcggattttccagcaataaagtgcggtttaattttatgctgttttgttgtaaataggcgacccctgctttcattcctcgcacatcataactgactgtcggcatcgcaaaattacattgaaaatattgttcagccagtattaagcaatctcttaaacgtctttggatttgcatttttatatgacgaaactcagctaaattttgttcagttttaggcataaagtgcggtcaattttgggtaagatttataaacaaaaggcgaactgttgagttcgcctcatatgagaaattaatcgttattttaaacttgcggcagcacgtaattcttctgcacgatccactttttcccaagggaattgttctcgtccaaaatgtccataagcggcggtttgacgataaataggttggattaaatccagcattttaattaagccataaggacgtaaatcaaaaaattcacgaatcagagcaaccagtaattcattggcaacttttcctgtaccaaaagtttccaccataatcgacgttggttccgctacaccgatagcataagaaagttgaatttcacaccgatcagccagccccgcagcaacaatatttttggcaacataacgagcggcataagctgccgaacgatccacttttgacggatctttacctgaaaatgcaccaccgccgtgtcttgccgctccaccgtaagtatctacaataattttacgtccagttaaaccgcaatctcccattggaccgccaataacaaaacgaccggttgggttgataaaatatttcgtctcttttgataaccattctgccggtaaaatcggtttaataatttcttccattaccccttcgtgaacagttttttgatcaacattatcagaatgctgagtggaaaggacaactgcgtcaattccgacgattctattatcttcgtatttcaacgtaacctgacttttggcatcgggacgcaaccaatctaatataccttttttacgcacttgtgcttgacgttccattaagcggtgagcataagtaatagcggcaggcattaaaacgtcggtttcattcgttgcatagccaaacataatcccttgatcaccggcaccttgatctaatggactttcacgatccactccctgattaatatcagaagattgtttaccaatggcatttaataccgcacatgaatgcccgtcaaagcctatgtccgaatgtttatagccaatatcgcaaattacttgacgtgttaagttctcaatatccacccaagcagaagttgtaatttcaccgccgactagagccatacctgtttttacataggtttcacaagctactcgagcttttggatcttgtctcaaaatctcatcaagtactgcatcggaaatttgatcggcaattttgtccggatgtccttccgatacagattcggaggtaaataaataagatgacatagattttccttaatggtagaaatttttattaatattttttttagatgttttaacgtctagacggctatattacgcttttttaattaaaaggcaagtcttaatttaggttgtataaagggacagattgtgaaacaatctgcaaattattcggcattgtgcggacaacaatattttcatttcaataatttaacaattctcaaaaaagaaaatatattggttagcacctacttcatgtcaaggttattaaaaattaacaattaattaaggtgaaggagagtgatcgatttcgatggatatcgccctaatgtaggtatcgtgatctgcaatgcagaaaggcaggtgctttgggcgaaaagatatggacaaaactcttggcagtttccacaaggtggcataaatgacaatgaaactgctgagcaggcgatgtatcgtgaattatatgaagaagccggtttaacaccgaaagatgtcgagattttatatgtttcaaaacactggctacgctataaattaccaaaacgcttacttcgtcatgataaccgaccaatttgtatcggacaaaaacaacgttggtttttattgcaattggtttctgatgaaaaaagaatcaatatgcagcacacaaaatcaccggaatttgatggttggcgttgggtcagtttttggtatccggtgaggcaagttgtcacatttaaaaaagatgtttaccgtaaggtaatgaaagagtttgcattgtttttatttgatacaaatttaaaatctcgactatctgtaccggaagaaaaaaaaatgttttcatcggttaagaaaaaacttattcacaaaaaaaatcataaatattcttcaaatcagtgagggggataaaatgttaaccttttttctcatttgtctaggtgtaggaacctttgcagggtttcttgctggattattcggtattggcggaggactcattattgttcctacgcttgtgtatttacttccgatggttggtgtgccggatcatctgctcatgtcaaccgcacttggtacgtctttcgctacaattgtcatcaccagtttttcttcagcacagcgtcattacaaacttggtaatgtagtttgggatgcagttaaaattctcattccaactctgatgttatcaacgtttgtttttaccggtattgtcagtcaattagataagagtttatccagtaaactctttgcagttttagtcgcttatatggcaataagaatggttatttccactaaaattcaaatcaaaaatactaaaaaactcactcctttatcgtcagttattggcggcgttttaattggtattgtgtccagcattgcaggcattggcggtggcggatttatcgtaccgtttttaaattctcggggtgtagatataaagaaagctattggatcttccgcagtttgcggcatgctattagggctatcgggggcactcagttttatgcgtagtggttggggcgttactgaaatgccggaatattcgcttggttatgtctatttacctgctgttttaggcattaccatcacctcattttttacgtcaaaaataggtgcaactacgacatccaaactgcctgtacctacattaaaacgctatttcgcaataatgctttgtgtgattgcacttaatatgctttttaaataaggaaatttaatgaatacattttttcaaatgccctatattgatcctgtcatgtttagcttaggacccgtcagtttacattggtatggtgttatgtatttgctcggttttggttttgcttattggctcggaacggctcgggcgaaaaaatcaaatggagtatggacatcagaacaactggaacaattattatacaacggattttttggcgttattttaggtggaagaatcggtgatgtgttcttttacaacgttgataagttttttgctgatccactctatctatttcgtatttgggaaggtggaatgtctttccacggtggattaatcggcgtcattctcgcaatgatttggacatctcgtcgccaacgtcgctgtttttggcagactgcagattttgtcgctcctttaattcctttcggtttaggcatgggaagaattggtaactttattaacagcgaattatggggaagagtaacagatgtaccttgggcaatcattccttacgcttcaaccacacctcgacatccctctcaactctatgaagcctttttagaaggtttcattttattaatcatcttaaatctctatattcgcaaaccacgcccaaccggttccgtagcaggattgtttctaatcggctatggtatcttccgtttcctagtggaatatgtacgagaaattgatcacaacgtaaataccattgatgaccttctcactcgagggcaattactctgtttaccaatgatattcggcggacttgccgtgatgatttggtcttattctcgttcaaaggcaaataaaagtgcggttaaaaaagggtaaatttttatgcgtcaatatttaaatttatgtcaacgtattattgatcaaggtcattgggtcgaaaacgaacgcacggaaaaacgttgcttaacggttattaacgccgatctcacctatgatgttgcaaacaaccaatttcctttaattacgactagaaaaagttactggaaagcggctatcgctgaatttttaggctatattcgaggctatgacaatgctgctgattttcgtaaattaggcactaaaacatgggacgcaaatgccaatgaaaatcaagcatggctcaataatccggtacgtaaaggtacagacgatatgggaagagtatatggcgtacaaggtcgtcgttggcggaaaccgaacggagaaactgtcgatcagctacgtaaaatcgtcaataacctgagcaaagggattgatgatcgaggagagattttaacctttttcaatcccggtgaaattgatctgggttgcttacgcccctgcatgcatactcacacattttctttactgggcgatacactttatttaaccagttatcaacgttcatgtgatgttccgctgggactcaatttcaatcaaattcaagtattcacattcttagcattaatggcacaaattaccggcaaaaaagcgggacaagcctatcataaaattatcaatgcacatatttacgaagatcagtttgaattaatgcgtgatgtacagcttaaaagagagccgtttccgcttcctcgattagaaattaatcctgatattaaaaccttggaagatttagaaacttgggtaacaatggacgacttcaaagtgattggctatcaatgccatgaggcgattaaataccccttctcagtttaaaaaataggaaaaacctcaacagtgcggtctgattttgatgaaaaaatgatgcgttatgccttatctctagcggataaggcggaggcattgggagaaattcctgtcggggcggttttagtggataaacaaggcgatattcttgcagaaggatggaacctatccattattcacaacgatcctaccgcacatgcagagattattgcattacgccaagccggacaaaaattacaaaattatcgtttacttgacacaaccctctatgtcacgctggagccttgtacgatgtgtgccggtgccattttacacagccgaatcgggcgtttagtattcggtgcttatgactacaaaacaggtgcggtcggctcacgctttcatttttttaatgattacaaaatgaaccatatgctggaaattacagggggtgtgttgcaagaagaatgtagccaaaaaattagtacattttttcaaaaacgtagaaaacaaaaaaagcatttaaagcccaactttaaacctttcctttaattcttgtaactgatctctaattgcagccgctttttcaaattctaaatcttgggcaaatttatacatctgttgttcaagttttttcacttgttgttgatagtccttaggcgaatttatcttttgataaagtgcggatgattccgccacagttttagcacgagcctttgttttacttttcgttatagcaccttgcccaatatccagtaattcgcccacttttttatttaaagcctgtggcacaacgcctttttccgcattgtatttcatttgtttttctcgccgacgatgagtttcatcaatcgctttttgcatagatttcgttatgctgtctgcgtataaaatcgcttttccgtttaaatttcgtgccgcacgaccgatagtctgaataagagaacgttcagaacgaagaaacccctctttatcggcatctaaaatcgcaactaaggaaacttccggaatatccaaaccctctcgcagtaagttaatcccaactaatacatcaaattcacctaaacgcaaatcacgaatgatttcaacacgttcaacggtatcaatatctgaatgtaaatagcgaacccgaataccatgttcttccaaataatccgtgagatcttccgccatacgtttggttaacgtggtgaccaaaactcgctcattttgctccgctcttttccttgcttccgataacaaatcatcaacttgaatcgctacaggacgtatctccacttccggatcgagtaaaccggtaggtctcacaacctgatcaataatttcatcgcccgatttttccaattcataaggccccggtgttgccgaaacgtagatagtctgcggtgctaaacgctcaaattcttcaaaacgtaatgggcgattatccaacgccgaaggcaaacgaaaaccgtattccacaagcgtttctttgcgtgaacggtcgccacgatacataccgcctatttgcggaacagtgacatggctttcatcaataattaacaaaccgtcacttggaatataatcaaataacgttggtggcggctccccctcatctcgccctgataaataacgtgagtaattttcaatccccgaacaatatcccaactcattcatcatctcaatatcaaattgagttcgctgagttaatcgttgttcctctacaaggcgattatttgccaacaaatattcacgacgtgcctgaagttccaacttaattttttcaatcgcctctaaaatacgttctcgaggtgtaacataatgcgttttaggataaatagtatagcgaggtatcgcaccaaaattcgctccggtcagtggatcaaataaactcaaacgctcaatttcatcatcaaataactcaatacgtactgcccgatcatcagattcagccggaaaaatatcaataatttctccccgcactctaaatgtccctcgttgaaaaacctgatcattgcgggtgtattgtaattctgccaatttcgccaaaatttggcgttgatcaacaatcgcaccatgttgcaaatgcaacatcattttcaaatagctatccggatcgcctaaaccgtaaatcgcagaaacagaagcgactacaatcgtatctcgtcgctcaagaaaagatttagtcgcagacaaacgcatttgctcaatttgatcattaatcgaagcatctttttcaataaacgtatcactactcggcacataagcttccggctgataataatcataataagacacaaaatattccaccgcattttccggaaaaaaagccttcatttccgcataaagttgagcagccaaagttttattaggagccaacaccatagcaggacgattcaatttcgcaatgacattggcaatcgtaaaggttttacctgatccggtaacgccaagcaatgtttgatgtgctaacccatcattcagattctccgctaattttgcaatagcttgtggctgatcaccggcgggttgaaagtcggaatgtaaaataaaaggcttactgttaattttgctcatagcaacaaaaatactaaaaaagggcggtgcattctagcataaaaaaacgtttctttactgacaaaaataggataagataacccgaatttttacttgacaaataaaatagaacagaaaaaatgacagtctacagtctacagtctacagtctacagtctacagtctacagtctacartctacagtctacagtctagtatgttgcctaaaatcaacctttcaagttaaatttgagaggttggacatgttcaaacaatatcttaaaaatcacctatttcaacctcaacctttcggcgaagataccattcgcctttttttgttgtgtcttaaaaagcaaggcatttcctgtttaggtttataaccaactcctaaaaagtttactaaacaatcaatcaaaatcaacgcaagaaataattaatttaaaaaatccatttttaaagagaatagagatatgaacaaaatattcaaaaccaaatacgatattaccacaggtcaatgtaaagccgtttctgagttagccagcaatcgccaaatagcgagcagttcggagagtaagccgaagtgcggtgggttttggggtaattttttaagagcgtttaaggtccttccgttggcgttgttgcttgcgggatttttctctaattttgcttatgctgctgatgtttggttagaaaataaaaaagacttatcacaaaatggacagttaaatgaggggactggtgtttggtttgacggttcaaatatggaaaacccgatcaaaactgagtcaaccatcttatcgagtggagaaaattcaacaggagaatttgctcaaaaagctggttttaaaaataaaagttttaataggacagtcgtaataggctcacgtgccgttggaggcggagatgctactacggtaataggttatagagcaattgcaggagcaaatttatctgaaagacataaattatcttcgcaaggtacatcgataggttacagaacatttgctagaggggaaggggctactgcaatgggaaatgattccactgcatggggagataacgctattgccattggttctgataatgcgaaagcaacaagcacttcacaaatagacagcagagcagaacgtcctttaagtagagatgtttggaatcttgtacacagcaaaagaagtgattttctttatacagatgaatacgcaacaacatatcaaaagttggatacttatgacaagtatttaggagtaaaagatgattctgaagcatataagctaaaaagatcccacacatgggcaaggggacataactctatcgccattggggcaagaagtatagcctacggcgataacagtacggctatggggacgttagcgacagccatcggtaactactcgacctcgttgggggcattttctatggcgtttggagatcgttcgattgccatagggaatgaaagctatgtgtatgccggcggaagtgtcggggttggtaatgaggtgcaggcaatcagtgatggtgcgatggtttatggcttggaatcttatgcgggcggtgatggttccattgccatagggaaacgtgctttagcaaacgtagaaatgggggatatgtttaagaatgctgttgaaaatggcaagaatttatacgaagcagagagtactttttcaaagttaggcgaattagataatagcgttcaagattactttaaaccaagcactgagtatcagcagggttccggggaacacaaagccaaacgaaataaaaactcaggcaagcaagatgctacaggcggtttagccattggttactatgtatccgcactaggggaaaattcattggcgttaggtcgtcaagcctatgcgaaaggcgatcgctccatggctatcggtccttatgcstatggtgctraggaaaaaacwgcygcactrggttatrgatccaaggckataggaraacaatcaatggcgttaggatcgctrtctcgtgcagaggggmaaaacagtatcgctattggggtcaatagtrcggtraaaaatgaawmtarywstawwaaaagaaacggtswaaacacgatagccatcggtaaygaaaccgaagcgacgatggataaytcmgtkgcmttgggttataaatccacsacraaatatttttataataagagtgataacagtaccgccacgttaaacggagatgaagccatyastttrccatcytatgcaccggaagggacaagytataagttacaaaccgataatgcrgcsggtatcgtgtccgtsggytggaaaaaaagcgawagtgarctkggyytaagaagaattgtcggggtcgcygcaggagcwttrgactccgacgtsgcaaccgtgggwcagttaaaagccttgtattaygtsaaaaaagaaggkgtrgtmacttactataccaaagaasctgacggsaaaatcacyaaactcaccaaagacrgcagtaagttttataragtcaacaccaaagacggcacgccttataaagagttgcaggaagttgatgcaaaagatgttttcgtcggtccaaaaggggcgaatgaagaaacaagagaagaaatgaaagacggcaaaaaatattcccttggtaatatgggtaatctaattaaatttgccaatattttagatggagagatttctgcgacttccgatcaggcggtaacgggtggtcagcttaacgatcttaacggcaaattaggattgacactaaatagcaaaaaaacaggctttgagaaagtccaatttgatgcagtagatgtagctgatgaaaacgttaaaaaaggaaaaatagaaaatttcaaagaagccttgactgactctatcgctgcaattaatagaggttataaatttattgatgacaactctcaaaattcagacaaagatacacctttctatctcggatcaacaataaaaattgtggcaggaaatatttctgcacaaccgaatagcaaacctcaagaaacatatttaggtaaaaacctcaaaacaaaatttgaaaaagagccaagcaacaattcaatcgctaaatttacgattggcttaaaagacgatccgacatttacaaaggtatccttagaggcagaacaaacatataattctgacccatcaaaaaatacagtcaaagatacaaaagaacttatcactaaaggttacttggacggtgcattaaaaaacgtcgcctcaagtttcacggttaagggagatgatacaagtaaatcattgagcattgataaaaatcatacgactttaactattaaaggcggaaacaatattaccacagcagttgatactaaccaaaaagccttaaccatatcgttgaatgagagtttaacaggtattacctcaattagcggtaaaaatggtagcggaagtaacagaagtgcggtagcaaaaattgagtttgatagcactgcaagcggtagcaacgcttcaaccccgaatgtcaaaatcaccacaggtggtggcacatttatctttagtgaaaacggcttaaatttgggtagcaaaaaaatcactggtttagcagagggttcagacgacaccgatgccgttacctttaaacaactaaaagattcaaaattgcactttttatcggttaaagccccgacaagcccagagtcaaaaagcaattacaataatgacggtgcaaaagctgaaggggcgattgctatcggtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcagacgtgaaagcacaaagtgcggtrgtratyggtaaaggtgcgaatgttcaagccaaagccgcaggtgcggtagcgattggsgaaagtgcgryggttgmmaccrccgcaggggattctattgcgttggggaaaaattctaaggcggaaatgaaaaagatcgcaccgactggacttacggctaatgcaggtgcaaatgacctaaaaattacttggnnnnnnnnnnnnnnnnnnnnnnnnnnnnnnnnnnnnnnnnnnnnnnnnnnnggtagtgaacgtattatcaccaacgttgcagcaggtaaagtcgatacagattcaaccgaagcggtgaatggcggacaattaaaaagcgttatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaactctatctcggttcaaccttaacgattaagggagcgacaggtcctgcttcaaaaccaacaacaagtgcggggcaaaacggtgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaattcagtggcgtgtctgaaattagcagtaaagataataaatctacattaaaacttggtgctgataacgcaacggtagaattagaacatggcaaatcaaaacttgaactaaaagatactgaagcaacaatcacagcaggaactgatgctggaagtattaaaattaacaataacggtgatacgaaaatcgagttaagycctgaaagkggttctacagtkaccttrgyaaaagayrntnmrratggcgtaaaagccacgggkttatcyasggttgggttagatgryrryaaygctttagtgtttaaaaatggtacgagtgacactaacatggcrgagttaaaagtsggyggtgcagctttaacattcacctctactggaaatggaactggcggaactgctcaaaccgtgaaaatctctaatgtggcggttggtaatatagcgactgattcaaaagatgccatcacgggcggacaacttcatgatttagcaagtaaattgggggttgctgttgatagtggaaaaactacgtttacagcaccatcatttgaagttatcaaaggcggtactaaagacgcaacgagcggtacaaatcctccaacaacctttaaaggrgcgattgascagttaatcacsgcrgtkaatggtggcttgamwtttaaaggcaatgatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgttaaataaagctacttctgtagataaaaatgacgaaaaagtcgttacctcaaaagccgtagcaacggagttggaaaaatatacgaaaactgctgatttaggtaatgcgtatttgaaaatagatggatcgaatattggcgatgcttccaataaaaaaacattcggtggyaatgtcggtattgctgaaatcaagttagatagtgamaaragcrrcactgaattagtacaggcggatgcggttattaagtatctaaaaggtacaggaacagattctgtaaaaatatcagactcaacaaagacaatggctaaaggaaattactcaataagtataggacatgaagccgtatcagaaaatgnnnnnnnnnnnnnnnnnnnnnnnnnnnnnnnnnnnnnnnnnnnnnnnnnnnnnnnnntaggtaatgaaagtgaggtattgggcgagaaatctattgcaataggttcagaaaataaagtagatggtgagggtaaatactcagcagtattaggaatagagaataaagtatcaggtaaatttagttattcagtaggataccacaatgatattaaaggagataatacctttgtattaggatctaatatattaacagacaattctattaaaaatgcagtaatacttggagatagatcaaaagctgaagcaaatgcagtatctgtgggtagtgctggcgatggtgaacaaagaagaattgtttatgttgctgatccaacgagtaaatacgatgcggtgaataaamamtatgtngatgcacttggattaaaattcaaaggtaatgatgataaaaatatacacagaaaattatcagaaacattagaaatagttggtaagggattaaataaaaaccaaactactaaatttaatggcacaaatggaaatattgctgtaaaagaaaataaagggaaattggaaatatcattaaatagagatttaaaaggaattaaatctattagtgatagcaagaataaaaatatagctactgaaataagattcaatagaaaaaatgacacaaacagtatttctaatagtttgataacgaacctaactatttcttcaaatggaggcacatttgaatttaatagaacaggtttgcatatcaacaataaacaaattacagggttaagaagtggactattagaaaaacataatggacaagatggagaaagaaaagatttagactatttaataggaaaagactttgataaatcatcgattaaaactcatgcagtcaatgttggagatttagcgaaaatttctaaggaaatagttgaaaaaggatataagtataaagctgatattccgtcaaataatagcaatgataccagcataaaactaggctcaaccatatctattgttaaatggacagacacaccggcgactggacaaccagcagtaactgttggcacaggaacaacttctcaaacatcagctgttaagtacacaggagataatttaacaactcgatatacctatgtcagtagcaatggcaacgccaaratcgaaatmgggtttaaagacgcaccgacatttagcaaagtgactttatcasaagctcaaacgtatggtaatagtagcaatgttggcgacaaggacytgattagcaartcytaycttgatgccgcattaaaagactttaagtttaatgtggaatatggtggtcagaaagtccaaatcggtcgtggcgatacgttgaagtttaatgctgggctgaatattaaagtagagttannnnnnnnnnnnnnnnnnnnnnnnnnnnnnnnnnnnnnnnnnnnnnnnnnnnnnnnaacttctaccccagcaccaacaacagtaagtaccccatcagatggtgcaaatgnnnnnnnnnnnnnnncaacaacggcagagataaccattgcaacgactgatgaattgaaaaacatcacttcgatttcctctaaaggaagtgcgggtttaaatgcgggtgactcaactgatgaagtcactaaacttactttagatccaaatagtggtgcaactttccaagttggcaacacaggttctaaagtgaatgtcaatagcgatggtatttccctcacgccacaaggggcgaatggtacgagtccatctgacgatgtagcatcaatcgctattaaagcaggcgcaaaatcagtggatccaagcaatttagattcacttgatcctaataayggaccttcaatagcgtttgcagccaaaggcggtagtaatggttcaaaagagggaacgggtacaattaaataccttaaagacagaactgttagcaaaaacaatggcaacggcgataaatacggtacaggcgataacaaaggcaacgctgccacagaaggggcggtgaaagagctttatgactccggcttgaaatttgccggcaatgaaggtgagcctgttcacaaaaaactcggtgaaaccttgtctattaaaggcgaaggtgcggttggtgaaacggcgacggataacattgtggtaagagccaaagagggtgaactgcaaatcggtctgactaaaaatattagaaatattgacaccatttctatcgctggcacaggggacaatagcggtaaagatgtctttatagatgctgagggtatgaccactactgctcaacttgaagatggcacggtgttggtgaataaccaaacggctgaaggtgtcagtacaatagctaaaaaagaggatggtagcattttggtgaataatcaaacagcagaagcgaatattttaagcaatggcaagcacacgacagaggtgaaagccggtgaggtcgctattaaagacaagagcggtcaagaaatcgtgagcttgaaagtggctgagggtgaaaacggtcaagatggcaagggagcgacgcttgcgtttgccaaagatggcgaaaacggtacaggcgtaatcatgggcttgaaagacctagatgccactgctgacggttcaagtgcagcgaataaaaactatgtggatgaaaaaatgtccgatttggacagcaatcgaccgtttgacttctatatccaagagggcaaagagtataccaaagtcgtcaaaggacgtgatggtaagttttatgatcctgagcttttacaaggggcaaagtatgatgtggacagcaagaaatacattgctcaagatggacaagaagttacaccggaatcggataaagtcattattcgtgctgaaccgactaccgcacctatcgggataaataatgtggcaagtggtttggggatttcggctatagaagaaagcgaaaagcaacaacttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaccaatgcactttcgcaagttgccagcgaacgtcctgcgttgctaatgcaaaaagcggaaattgaacagcaacttaagggattgggtgcgagcgatccacgaagagcaaccgcacaagccgaacttgataaggtaaaagaggctcttacacaaaatgatcaaaaggtgactgaggcgacaaaaacagctaatgaggcttccgaagctctcaaacaagcgaaagtcgctttggcagacaacgtgttaaaagcctatgcagcacaacaagcattagctactgccgaggaaaccttgcgaaataaagaatttggcgtggataaggtgaaagacttactgtcaggcaattcaaatattgctgaggataatgtggctactattaaagatgtgaaagcacttgctaaagcaggattaagttttgagggcaatgatggtaaacgcttgcataaagatctatcagaaactttagcaatcaaaggtgaagaaaatgcaagtggtgataaatttaatagcgaccacaccgccgccggcaatatcaaagtggaaatggcacaagacggtaaaggcttagaagtcaaattgtctgaccagttgaagaacctcacatcggttgaaactaaaaaagacgaccaaggcagatcaacaacattgctgtcccgtggagtgatggttcaaaatgacaccacaaaagaacaagccctgttcagcgaaaaccgtttagcgttctttaaagatggagcgttaggattgaatttagacggtaagtctcgtgcattgaaagtcggtgaaaaagcgatcatcagtataaacgacaaaggtgaagcattggtttccgatctgaatgaatttagttcaggtatgacaattaccaataaaaactatgtggataccaaaaacaatgagttgcgtacgcaattgaataatactgaccgcactttacgagcaggtattgccggttcgaatgcggcggcagggttggcatcggtctctatgccgggtaaatctatgttagccatttctgcagcaggttatggcggggaaaacgcagtggcaattggctattctcgcatgagtgataatggtaagattatgctacaactgcaaggaaatcggaattctagaggcaaagcggcgggttctgtttctatagggtatcaatggtaaattgattcgattgtgccttatgtccacattttgttattgaggatataaggcataaaaagcgtgctctgttttaaaatcaacttggtaattgttgttcgatttattgacgagttattaagtttggtttctttttacatagacaaggtttaaaatggattagattctgttttaaaccttttttacaattaggcaaagcacttaatatcaagaataactgtctgtatctatttcaaatagctatattgctatctatgatgatggaatattgctcttgatgtttgtagcaaaaaattacatagactttaaacgaggagaagaaatatggaaaaattcgatgttgtgattattggtgcaggaccttccggttctgtttctgcatcattattgcataaacaaggcttaaaggtttgtgtattggaaaaacagtactttcctcgttttgtcattggtgaaagtttgttaccttattgtatggatattttgcaagaggcggacttggttgatgcggtacatgccgagaaaagttttcaatttaaaaatggggcggcatttacttggggaaatcgttacacctattttgattttacagataaatttaccgctggacctggcacaacctatcaagttcgccgaggcatttttgataaaattttaattgatgaaacggcaaaaaaaggtgtggaagttcgttttgggcacgaagtatcggcgtttgataaccaaggcgatcaggcagagcttgcggtaaaaacggagcaaggggaagaatatcggctgagtgcaggttttgtgttggatgccagcggttacggacgtgttttgccacgcttattatatttagaaacaccatcgcacttgccaatacgtattgcacattttacccatattgatgacaacattgatgatccgatctttgatcgtaataaaattctcattaccacacatcctgaacatcgtgatgtttggctttggttaattccctttgcggataaccgttgttcaatcggtgtagttgggttaccggaaatattggcgggtgagagcgaaactgtgttgaaaaaatttgctcttgaatgtccaatgctgagtaaaattcttgctaaggcaaattgggaaaatgaatttccgtatcgccatattcaaggttattccgctaatgtgaaaacgttgcatggcaaacattttgctttattgggtaatgctgcggaatttcttgatccggttttttcatctggcgtgactattgcgttacattccgctcgactggcaagtcgtcttattgctcgtgggcttcaaggacaagcggtggattggcaacgagaatttgccgatccgttaatggttggtgtgaatgcgttccgtacttatgtaaacggctggtatgatcgtagtttccaagatgtcatttatgcccgtaatccacaacctgaaattcgccaaatgctttcgtctattcttgccggttatgcgtgggatgagaaaaatccgtttgtggcgaaatcctcccctcgcttgaaagcacttgcggaattatgcggcgaggcaacacaagattaagataacaatatataagcattcaaaaattgctatttgcaaacgttgagtgcttttattttttcataaggaaacaccatgccatcgtttgaaaatctttcttttattaccgcacttttatttttttgtatttgtctcattttattttttatttttgtacgtaagcaaagagaggtggaggcgttacaacaagagttagataaaaatattaatatttttaatcaattgctgaataaatatgaacgtataaaagacgaaaaaactcagcttgggcaacaagttgtaaaggcacagacacttgtcgaaaccggtcaaattcgtttgtcggaacgtgatgaaaaaatcctttatttgcaaaaagaattagataaagaacaattacggtgtgagcaagtttctcagctggtaacaggattgaaagagcgtttgggggtagtaagtacacaggcggaaagttttcaacagcagttaaatcaaagtcgtgcagaaaaagaaaagagagattgtgcttgggctgatttaaatcagaaacataccgcacttcaacaagaactgacagaattaaaagtcacgttaagtgaaaaagaaaaaaattttgtcgagcaacaacaaaatttttctcaggctaaacaactgttaagtgttgagtttcaaaatcttgccaatcggatcttggaagaaaaaagtcaacgatttaatcaaactaaccaacaaactttagacagtttattgaaaccttttcgtgaacaaattgatggttttcaaaagcgggtgaacgaaattcattccgagtcattgaaaggcaatgccagccttgaaagtgagattaaaaaggtgttggatattgggttggcaatgtcgaaagaggcgaataacttaacttctgctttgaaaggcgaaaagaaaaccttggggaattggggagaagttcagttagagcgtacattgcaattagccggattgattgaaaatgagcattacagcagtcaagtacattttaaaaatgagcagggcaaacataattatcctgattttattttgcatttacccgataataagcatttgattattgacagtaaaatatctttggtagcttatgaaagtgcggttaattctgacgatgaaaatcaacgtaaacttggtttacaggaacatgttaaagccttgaaaaatcatattgacgatttatctcggaaagattatagcaatttgattggtatgcgtagtccaaattttgtattgatgtttgttgctgttgaagcagcttatattgaagcgatgaaacatgacagtaacttatttaattacggatatgaaaaaaatgtcattttagtttctcacacgacattaatgcctattttgcgaaccgtagcaaatttgtggcggattgagcgtggtaatcttgaagcaaaagaaattagtgcaaaagcaggtgaaatttataatcaaatttgcgtagtggcagagcgtttaaataaattaggtaacagtttatccggtgtaagtaatcattataataataccgttaccgcacttgtaggacagcaaggtttggtgggaaaagttgagcggtttaaggatttatctgcaaaagcgaacaagataatgccggagattgaattgttgcataatgatataaacgttgagaagttaattgccgttcaagctgaagtcgaagagaaataggatttttagctaaaaatcttttaaaataatgacaattttgacataagagggaatacattatgattattgttacaggtggagcaggattaattggaagtaatatcattgcggcattaaacgatatgggacgtcgagatattttggtagtggacaacctgactgatgggacaaaatttgtcaatttggtcgatttggatattgcggattattgtgataaagaagattttattgcctctatcattgctggtgatgattttggagatattgatgcaattttccatcaaggcgcttgttctgctacaacagaatggaacggtaaatatttaatgcaaaataattatgaatattcaaaagaactattgcattattgtctattgcgtgaaattcctttcttttatgcctcaagtgcggcgacttatggcgataaaacagactttattgaagaacgccaatttgaaggtccattaaatgtttatggttattcaaaatttttatttgatgaatatgtgcgtcaaattctgccacaggctaagtcgcctgtttgtgggttcaaatatttcaatgtatatggtcctcgtgaacaacataagggttcaatggcaagtgttgcattccatttaaataatcagatgttgaaaggagaaaatccaaaattatttgcaggatcagagcattttttgcgtgattttgtttatgtgggcgatgtggcaaaagtgaatttgtgggcatggcaacatggtatttcaggcatttataattgtggaacaggtagagcggaaagttttgaacaagtagcaagagcggtgttgaattatcatggcaaaggtgaaattgaaactattccgttccctgagcatttaaaatcacgttatcaagaatatacacaagctaatttaacaaaattacgtgccgctggttatcaagcagaatttaagtcggttgctgagggagtagcggaatatatgcaatggttaaatcgcaagtcttgatttagcgaggaaaatagtgttaaaagtgcggtttaattgggtgttcatttattcggtattccttttaaatctgcaactaaaaagactattttgctttataatatcggcaatcttcactgttattggtcaaaacctatgaaaattctcgtaattggaccttcttgggtgggtgatatgattatgtcccatagtctgtatcaaaccttaaaacaacaatatcccgattgcctgattgatgtattggcaccgaattggtgtaagcctttacttgcacgtatgcctgaggttcgcaatgcgattactatgcccattgggcatggttcctttgacttaaaaggtcggtatcgaattggtaaatctttgcgtaatcaatatgatatggcgattgtcttgccaaattccttgaaatcggcttttattcctgcctttgcgaaaattcctgtacgccgtggttggataggagaaagtcgttattttttgttaaatgattggcgtcgcaataaaaacgactatccgatgatggtacagcgttatgtggcattgggttatgataaaaccgtattgccgacagcaaaacatttagccattcctaagccttatttacaagttgatgctcaagcgttggaacaaactttagaaacttttgcaaaacaaaccgcactttgtacaaatcatccggtaattgggttttgtcctggtgcagaatttggtcctgcaaagcgttggccacattatcattacgccgatttagcccgacagttaattgaacagggctatgccgttcgtttattcggttcggtgaaagataaagaggtaggtgagcaaattagtcaagcgttgcctcaaaaattacaacattattgtgtaaatcttgctggtgaaacagacttaaatcaagctgttgatttgatttcagattgtgtagcggtggtaagtaatgatagcggtttaatgcatattgccgccgcacttaacaaacctttggttgctgtttatggaccaacaagtccggaatacacgccgccactttccgacaatgctgtgattattcgtctaattgagggaggcttgattaaagtgcgtaaaagtcaagatagctcggaaggttatcaccaaagtttaatcgacattacaccgcaaatggtcatcgaaaaattacaggattttttaaattaatatgaaagtttgtttgattaaaaccagctcaatgggcgatgtaattcatactttgccagccttgactgatgctcaaaatgctattgctgatctgcaagtggattgggtggtggaagaaaattttgcggaaattccccgttggcattcagccgttaatcatgttattcctctagcaatacgacgttggcgtaaacagcttttttccgctcaaacaagaaacgaatggaaaaattaccgcactttgttacaacaaaatcaatatgatgcggtaattgatgctcaagggttagtgaaaagtgcgttgtttggagcgagtttggcgaaaggggtaaaacatggttatgatcgtcattctattcgtgagcctttcgcctcatttttctatgacaaaaaatatactatttcttatcaacagcatgctgttgaacgtattcgtcaattatttgcccaaagtttaggttatgaattgcctcacgaaaaaggcgattatggtattgcgaagcattttgtgcattcgactgaaaatgcacaacattatgtcgtttttgtccatagcactacaagagcggataagcattggctcgatgcggaatggaaaaaattagcccaaaaattgaccgcactaggtttgcaaattcgcttaccttggggtaatgaaaaggaaaaagcacgtgccgattggattgcacaagatattcaaagtgcggtagttttaccgagattttctttgaccgagttggcacaacagattgcctatgcaaaagcggtagtttctgtggatactgggttagcacatttgaccgccgctttagatgttccgaatattactttatatggagcaacagatccgaagttgatcgggacgtatggtaaacatcaacattatattcagaaacagggtatggcgttgattagtgcggaagatgtgttgagtgaattacagtcaaaagaaatattgaaattttaaccatagaacatctgcactttgcatttacactaagtgcagatgagtttgattataaacggataacgccgtcataaatatgtgttgcctcgccggtcatataaagtgggtgtccttttccttgccattcaatcattaaccttcctcccggcaaatcgacttgtacgcaactacctaaaacgccctgcataatgccaacggcaactgctgcacacgcaccgctgccacaggcttgtgtttctcctgctcctctttcatacacacgcagtttaatatgattgcggttgataatttgcataaaaccggcatttacacgttcaggaaagcgttcatggctttctaagagcggtcctaatatttcgatgtttgcgtgttgaatatcttccacttgtgttacacaatgtggattgcccatagataccacaccacatagcaaggtttgtatgtctgtgcgaataatataatttttttcaaatttattggcgttaaaagggattttattcggttcccaaatcggttcacccatattgacacataccatgtcatcgtctttaacgcataacatcattttgccttttgcagtactcacggcaatttcttttttattggttaaacctttaagcacgacaaaacgagcaaagcatcttgcaccattgccacattgcgaaacttcactaccgtccgcattgaaaatacgatagtgaaaatccaaatccggatcataaggcggttcaacgactagcaattgatcaaaaccaatcccacgattgcgatctgccaatctttttatgacttcagtgggaaaataaacgttttgagtgacagcatctactacaacaaaatcatttcccagtccgtgcattttggaaaattgcatttcctcttccttaagcaaattaaaattggggctattataatcagcggataaagttgagtaaatgagagaaatcattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggagttaaattctaaaagcaatattctctccgcactttgaggcggggagaatgttaggttgttgttttgtaccattccaaaataaatgcggcaatttgcgtcgggttgttaatatccagtaaaggaacggaagtctgtacaggataatctgtcgctaacgctattacatattcatcacaaggcggacaaggttttgtcatattttgacgatgtaataaaattttggcgatggggtcttgtttaaacccttctactaaaattaaatctgtcaattggggtgaaaattgttgagcaagataatctaaagtgacaggttttggcgtttcggtcattaatgcccaacggttatcacatgccaacataacttgtgtcgcaccagcctctttcatacgccagctgtcctttccctctttgtcgatttgtgcgttatgatggctatgtttgattactgaaacccgcaaacctaaacggagcaattcaggcagtaatttttccaataatgtggtttttccactaccgctataaccggtgatacctagcatgggttgcatataaattcctcttttattgaataatgcgtaacagaatgggttgaaaggcctttttatgttgccattttttactgtatgaatggataagcacaaaagaaagtgcggtacaaaaaaggataaaaattgcaccccacaattcttggctaaaaatttggtttgcaatgagtgttgcactgagcaaggtcattaaaggaataatatacaataaaagtgcggtagaaatcagagaactttcttgtaaaccaagctcaacaatttgacctatttttaagggtatcaggctattaacgataaagatatgctccggacttttgccggttaattcagaaagtgcggaagttccgcaagaattttttgctgtacattggctacaagcatttttgctttgacatttcactgttgcttttccttgatgataggcaatgactatcgctctttctgttagcataaaaaacctatttaattcgaatatcttgaataatacgtttagcggaaaagagaggaagttgaccgacaaaggttaattctttgttacctagagtgttgctgtaaaaagtggtggagccttgcttccaaaatctttctccgtcattatcaacaatgctgttagacaaatagagtgcaaaagaaaatagtccgtcactataaaattggctctcaatagggtgtttattgtctttttctattgttatggattggctaattaacttaaacccttttgggagccactccggtttccaattttgttgctgagttttcggctcacttaataacggaggaaaaatgacattatctatatagctacctaattcgatcagttcatcaccaagatataaattaactactcggaactgctctaataaattgccttcacgatccaacatatcactgcgtagcaacaaatgattttgttcatcgataaagactaaatattgatagcgaaaatcgtctttaggcaaaatacgtaaagtttgtacaatgcgatccgccacacgattacgcccaatggttacgatatcgtaataatctgataattgcttaacatcactccacattacaacaggtaagttatccataatatgaccgctctttaaagagaatgcttggaaattaggtggaaaataactcactaaattttcatgttggataatttcttgttgaacaccatctaaggtaataagttgggcgtaacttttgccatcctgattaatatgacgataacgaagtgaatctatattggttggtgtggcttgtacaaaataaatttcataatttaatgtattttgtgctgcaatcattttttccaataattgctcaggttctatattttcttgagcgaaagttgaaactgaaaaagtaagaagtgcggtcaaaaaagagaaaatttttaacatagtattcttcctaagaaaaaaattcaccaccaaacggtggcgaatatcttaacatgaattgagctaatgttcattatttggcaatccgaaactgtcagtatgcagacgtcgttgtaattcatagttttgtaacattatgccaatacgtttgttccgttgttctacttgctcttgcgtaattatttcttttctcggaacattatagctgatttcttgtaccgaattattaaatggaagcgtttgtagcgttggggtatccagtgtatttttgcccgctctttcatgattaaaagattgaacgccaagtacggcaacgaaacaaaccgttgcagcaactgccatttgtaacattggggaaaagaatgagcgtattttttgtataaacggaagtttttccacttctgcgagtgtcggttgagactcgagagaatgttcgatttgtattttttcttcctgttcaatgagcgttcccattcttgctgtgaaatcagaacctaacagcactttactttctttgcgtataatggaacgaattaaatgataatttgaccaactattttgtaaatctttgttttgacaaagggtgtcagtaaatttgttaccacaatgctcaccatcgatataagctgaaagtaactctttttgcatctttaactccaagtctttgcttattaaactatttaacgttgtatcaaaggttgaattttgctttcgattatttctcttgcacggaaaatacgagaacgtacggttcccaccggacaatccataatttctgcaatttcttcgtaactcaatccttccatttcacgtagtgtaatagctgtttttaaatcttcttgcaggttactgatagtatcaaaaacaacttttttcaattcactggataatatttcattttcgggagtattcacgtcccttaaatttgtaccaacattataactttcagcgtcttccgctaatatatcctctgttggcggacgccgtccttgtgccgttaagtaattctttgccgtattaaccgctattcgatatagccaagtataaaaagcactttcgccacgaaatgattcaattgagcggtaggcttttataaaggattcttgtacaacatcgggaatatcgttttgtgaaatataacgagtaagtaatccagcaactttattttgataacgagcaaccaataagttaaaggcctttttatctccctgctgtactttttctaccaaagcctgatccgttagttgttcagccatataacctcttgtatcacatctaacaagccttaatattaaagccagccaacccctgtgcttgttagacgtaatggaataaaaaaagttcaatctttttaggaaagattattgatataaatttaaattttcttgaatatgatctaccatctcttgtaattcaagatcagcagccggagttttattaaaaaaccaagaaaaaagttgtaaatccgagcaagctaataaacgcaaaaatatatcttttttagcatcaggtagttcatcaaaatattgttgaaaaaaaggcataataactttatctaattccaacatgcctcggcggcaatcccattcaatgcggaatttgttgtatttttccatgcttaatttccttttatctaattttcttgttaatagtaacaatcggaagaaacgctgtaaataaaagagaagaataaactcggttcgggtagattttaggtgtgcaatataaatggcatacaaataaggcgtattatatatcaatacgcctttgctcttaggtgtaaatccctttaacttttaaccagctctactacttcacgggttaatcgtccaatttcttcccattgttgggacttaatcaaagatttctctacaaaccaagagccaccgcaagcaactacgtttggaatagcgagatagtctttgatattttgtggcgaaatgccaccggtcggcataatttgtaagttaccgtaagggccaagtaaggcttttatcattttaacaccgccacttgcctcagcagggaaaaacttgacagcttgtatgccgagttcaagagcggattcgattgccattggattatttaccccaggcgttacaggtatatttaactcttgacaatacttcacaatatttggattaaagcctggagtgacaagacaatctgctccggcgtttttggcagccaatacctgttctttggttagcaccgtgcctgcagctatgagtacttcaggatattgttggtgaaccaatttaatggcctcttcggcagcttcggagcggaaagtaatttccactacaggcaagccgttttcagacaatgtttttgctaagggtaaaatatcctctgctttatctaaagcaataaccggaacaactttaagctgtttcaacttgtcaataatttgttcagtggtataacgcatttttaacctcttttttaatgtgaaaaaatttctttaaaatggttattttatttgaaataacgttttgcattgtcatagcaaatgtctttcaccatctttcctagcaggttgagatcatttggtgcttcaccacgttcaacccagccaccaatcatttcacataaaatacggcggaaatattcgtggcgagtgtaagataagaaactgcgagaatcagtcagcataccaacaaattggcttaatagtcccaattgtgatagctgttgcagttggcgttccatgccatctttttgatcgttgaaccaccagcctgaaccgaattgaattttacctgcaatgccccctgtttggaaattaccgatcattgtgccaagcatttcgttatcacgaggatttaagcagtataaaatggttttcgggagttggtctgtttgatccatgctgtctaataaacgagaaagtgattcagcaaacgcacgatctccgattgaatcaaatccagcatctgcacctagcaatttgaacattctcgtattgttgttacgaattgctccgatatggagctgcattacccaatggtgtttgtggtactccgtacctaaccaaactaatagtgcggtgctaaattgtgcaatttcttcttcttcaataggttgattgttaagtcttttttgcaatatttgatcaagagttttctcatcaggaattggtgagaaacggacaatttccatactatgatcagcagatttacaaccatatttatcgaaatgttcaatacgtttcgatagagcctgttttagtttatcgaaagtgttgatttcaatatctgcgacttttcctaactgctcaatataatcattgaacagaggaagctcaattttaaacgcacggtcaggtcggaaacttggtacaacttcaacatcaaaggtattatcttctgcaatggctttatggtattccaatgaatcaataggatcatcggttgtaccaaccaaatttacattcatttttttcataataccacgtgctgaaaactcaggctgttgcaataactctttccctttatgccaaattttctccgctgtttcaggtgaaaaaatcgtgtcggtaataccgaacggacgacgtaattctaagtgagtccagtgataaatcgggttaccgatacattttggtacagtgttggcaaatgcgagatatttactgtacttatctgcacttcccgtaattaaatgctcttctaccccagctgaacgcattgctcgccatttgtagtgatcgccctctaaccaaatttcagctaaatcattaaattggcgattttctgcaatctcttttgggtttaaatggcagtgatagtcgaaaatcggttgtttttcagcataatcatgataaagcttttgagccgttgaggttgatagtaaaaaatcttccgtcataaatttcatcattatgtcctcttattgagttattttttgttctaatatacttgcgttttcgtccactttttctttagaaagcgggtaaacgtatttcaacagtaaaaaaatcaagatgcaagccaatgcaggtactcccgttgcaaagttatagattgactctaacacttcttgtggttgttgtgggatttttgcagaatagccaatgtaacttagtgcaaagccacctaaaccaccagctaaagcttgcccgattttgcgagcaaatgaataaactgcataaattgtgccatcttcacggcgtccagttttgataaattggttatcaataatatctgtaataaatgcccatataataatttggaaataacttagacccagtgttgcaatgagtgcaacaatgataaataaccaaacatttgtgattttaacgaagaatagcacactgtatatgacagcagttatcaataaacctacagaagctgattcttttttaccgtactttttcacaatattttgggcaaacggagcaaccataaatgttgtcacggcacctaaaataccaccaaatgacaatgctaatttactattaaagtaatcaacatacaaatatgggttcattgtaccgatgattaaggttgctagcagtaaaatgatagcgattaaaataaagataagtaacgcactgtttgagaatagactgctaaagattgcttttacgtcatctaaacagtctgatttattgtgtgatttgttgtggcgacgaccttctttttcaggcaattgaactcgctcaaccgaaaatctccaacagatttggtacaaaataaacgcacagatcataaatgctcccataatgtatgtgaacatttctgggataattacttgtttaccctcaacttctttgtaaataatgagtggaataacaaatgagataaaaagtaccgcaatatttgcaccaactgtacggaagatagataatccggcacgctcatcagcttttgtagtaatcacggaagccattgaaccataaggaatattgaccgcagtataggctaaactaccccaaactatgtaggtaacagtgatgtagaccaattttgcggtataagaccaatctttcacaatgtgcaagaaaagcagaaatcctgaaatacagataaagggagttgcccggcgaataagacctctgaaacgcccctctttaaaaggctttatagtatctactaaacgtcccataccaatatcagtaaaagcgtcaataaatctagaaactagaaatagaagaccgacaacataaccttcaatttgtagcacattagtataaaatagcattaaaaagaaggcggacatcataaaactaagatcattagcaatatcgccagccatataggcaagtttgtcttttaaaccaaaaggtctttgtgttgaactcataaaaactccttgtgaggaatatagattaaatatgggtatctttataaccgcagaacgcatcaactgggctaatacctttaaactcggaattacccattaatttttctaccagcaattctatggttggctctttgccgtcataagcattgatgtaagtttttacttgaggaacatcaactaaatggaacgggcattgaacggaaacgaaaattgttggtacttcatgtacatagaatggaatatcaggcgttcctttggtcgcttgccatacgatacgttgaactgtactcatttgcacattcgcaacattgataatcagatcataatgatccgttaatgttgtaattgggcgtttttgggagtattcattacgaatggttttgacctgatcttcgtccgacatcttgagaatattatccatcggtgatgtataaatagaaactgtaaatcctttttcttccagtttttcttttaagatttctgttgcactgcgttgactacctgcaaccattttaccgaagccaccatctgtacctttaacatttacaagtaagattctagggaaacgttcaacattaattgggaaaatatcttgtttatgtttaactaaggtaattgctttatctgcaacatcacggaaaattgctttatgttctggtagtcctatttttgctaatgcttgttcttttggttcaagcaatgtttctcttggacgattgtgtaagcctaattttgcttttaaccctagaatacgagtaagggcatcatgaaggcgttcttcggtaataatgccgtttttataaccttccatcatataaccgaaatcttcatcaggatcgttaaagaaaaggaataaatcacaacctgcagcgatagcagtcggtagcatttcgctacgcttcattgctgaagtcattgctaccatatggctggcatcagtaacaacaacaccgttgaaacctaatttacctcgtaataagtctgttaaaattggttttgaaagtgtcgctggtaggcagtcctcataagctaaatttggattgaaatgctgctcgtaagcaggtaagtgtatatgacctgccatcaacgatggtaaaccagcatcaattaagccttgataaactttgccgaaagtattgtcccactcttcgcaactaaaactgtttacactaaaagaaagatgctgatctctttcatccactccatcaccagggaaatgttttgcagccggggcaataccactttcttgaatacctttcatataagccaaggacatttctagtactttctctggatttgaaccaaatactcgattagaaataattgggtttcgccagttataactaatatcaacgataggagcaaaactccagttacaaccgatagctgctgcttcaataccagctacacgccccatttcataagcatatttagcatcatcggttgcaccgattttgacttgtaaaccaatttctgttccatcactgcaagcaccattaccaccagcttctgtattcgctgcaattaagagagggattttacttttagtttgtagaatatagttttggtcataaacctcctcagcaggaccgggattataacgtaccgcaccaatatggtaacggtttaaaacatcagtgagatattcctcggatctgcttgaacccatattcacaaaaagctgaccgattttttcttccaacgtcatattggctatagtgttttttacccattgaatatcttcatcttttaagtaataaggttttttcgttaaatcaacagacataatttctccttgcttatttgtcaaaatagtaataattgtgatcacgcggttagatttgcattaaattttgcaaccaattgggcttgatattgagaatcaaatttttggtaaaccaatttccctaatgtttctaatactaactgatcccaagattcatcttcattgccacataaaatcgggaagaaatttacacttgcttcattggcactatttaaatcacccggtgaatcaccaaccattaaaatattgttaggttgatagccatattgtgctaattggtttaaacaatgagtttttgtaccctcatcttgtccataaactagatctacaaaagggagcaaaccatgccttgtccattcatcaagaatagcctcattatttgcggaacttaccacagcgatgtctgcaaactctttaataatggcgagggaacgtttgactaaacggaatggtttatcttgagtatgtagagttttaatacccatattgactttttccgaccatgctaacgcaagttttagatcatcggtatggttgtcttgtattgcttgaataagtgaacgattggataattccgaagttgtatttacccagtgttttaattggctgaaatcctgttcataaccatactcttccaaagaaagaatcaatcctttgaatcgattgataccacgtgtttgagagtaaaggttaattctattccaaatttcaataaaacgtgcttcatctgtaagtccaaaaatttcaacagcataaggtccgaaacacttatcatgtttaatattcattgtatccattgcacaaccgtcagaatcaatgcacacaataaatttatgttttggtataaatgttgtcattattttcccctatacaccgctgtaagcagagaaaccgccatcaatcggcaatactaccccatttatgaagctggcataattttcatccattaagaataaaattccacccatcaattcatgtgcttcaccaaaacgtcccatcggagtattagttaaaattttattagctcgagctgtcggatttccttcactgtcaaaaagtaatcctctgttttggttactgactaaaaaacccggagcaatggcattacaacgaatacctactttagagaaataaacagcaagccattgggtaaagttactgatagccgcttttgctcctgaataggcaggaattttagttaacggagtataggcattcatgctagagacattaataatattagccccttttttgccgatcatatctttggcaaatacttgagtaggaagtaaagtacctaaatagttgaggttaaatacaaattcaataccatttttatctaaatcgaaaaatgattttgtactatctgctaagttaaattcatgaaattcattgtcggttgttgcttttgggctattaccaccggcaccattaatcaacacatcacaagttccaaagtctttttcgatagcatcacgagtttgttgaatactttccaaatcaagtacattggttttgtatgcttttgcaatgccaccattttgtacaatagcttgtgcatattgttctgccgattcgaggttaatatctaataaagcaacttttgctcctgtttttgctatttcttgtgcaaaaaatgcacatagcactccaccagcacctgtaataacaacgactttacctttgaaatcatgattgtttgcaatattcatatttttatctcctattaagattaattgatatgctaaatatacgtctatttttaaaactggtaaaccagttattaataaaagtgtgatttacatcacaaaatttaaacttttttggtttaccttttggttttttatgtaaaatatgcttaaattatagttgttttttggtgtgcgaaatgttaatttggtgaaccagaaaagtattttacgaacaccatcaagaagtcaaaaaagcagagagacaaaaaaatgatggcaacatcacctgaagaactacgttcttataaaaaaatagggcaagaattaaaagcggaattattgagaggaacttatggtattggggataaattaccggcagagcgtgatttatctcagtacttcaatgtcagtcgtactgttattcgtgaagcacttatcatgcttgaacttgagaatttagtcgaagtgcggaaaggatctggtgtttatgtaataaatttacctaaatcgagttcagaggaaactgaagatttgcctgatgttggaccctttgaattgctacaggcaagacaattgttagaaagtagtattgcagaatttgcagctattcaagcaactcgagctgacgttttacacttaaaagagattttagatcgtgaacgtagaactttagagtgcggtgatgatgaagattatattgcagatgaggattttcacaaagcaattgcagaaataacgcaaaatgaagtggtgatccgcatgcaaaaggatttgtgggagtaccgaattaatagtcctatgtggaaaggtctgcatgcacatatctctgatcaaagttaccgctatttatggttaaaagatcacgaaaatattattgttgcaatacagcgaaaaaatcctgtattagcacgaaaaatgatgtggcagcatttggaaaatgtaaaacagaaactgtttgaattatcggatttagatgatcctaattttgatggttatctgtttagtgttagccctttggctgctgatttttaattagatgaggaatttactatggaacaaacatggcgttggtatggaccaaatgatccggtatctttggatgatgtaagacaggctggtgcaacgggagtggtgactgcgttgcatcatattcccaacgggcaagtatggtcagttgaggaaatcaataagcgtaaagcattgttggaggaaaaagggttggtttggtcagttgtggaaagtgtacctattcacgaagatatcaaaacccaaacaggtaactatcagcaatggattgataactataagcaaacattgcgtaatctagcgagttgtggcattgacatagtatgttataactttatgccggtattagattggactcgtaccgatcttgagtatgaaatgccggatggttcaaaagcgttacgttttgatcaagtggcttttgctgcctttgaactatatattttaaaacgtccgggagcagaggaaacttactcaccggaagagcaagcagaagccaaagcctattttgatcaaatgagcgaagcggatattgcgaaattaacaaaaaatattattgctgggttaccgggatctgaagagggttatactcttgaggaatttcaagcacaacttgatcgctataaaggtatttctacagagaaattccgcactcatttagcctatttcttgaatgaaattgtgcctgttgcacaagaagtgggaatccgtatggctattcacccggatgatcctcctcgtccaattctcggtttgccacgtattgtgtcaactatagacgacatgcaatggtttgtggatactcaaccgcttgccgctaatgggttcactttctgtactggttcatatggtgtgttagcagagaatgatttagtgaaaatggcggaaaaatttgctgatcgtatttactttgttcatttgcgatccactcagcgggaggaaaatccacgaagttttcacgaagctgatcaccttgccggtgatgtaaatatgtttggggtaacgaaagcattactcaccgaagaatatcgtcgcaaggcaaatggtgataatcgcttaattccaatgcgaccagatcacggtcatcaaatgcttgatgatttgaagaaaaaaactaacccgggttattctgcaattggtcgtttaagaggtttggcagaatttcgtggtttagaattggcattaaaaaaagtgtattttaatgactaattaaagaataaaggtactaagtgtcttagctgggaagtatagttctggacatggtgtgaaagaaacccgacaaattgtcgggtttctttcatctaaaagagcggtctgttttatgctgttttgggtttgataacagaataaatgacacctgttaccaaagacacgatgctaattgcaacaagatannnnnnnnnnnnnnnnnnnnnnnnnnnnnnnntatattattttacacaaagttttaaaatttgttcgctaccctgcacgagatattgatcatcttcagatcgtactcgattatttttcaagtctaacatggcatcataaataccttgtgtcagacttgcttgatcaagatgactccaacaagttgaacttaatctattaaagttggtttgtaatccgaaagcaaagagaataccgctataataagtatgcacatcgctgtctaatccattgcgttgaaacagtttttctttaatttgattgatcgggactgaaatttttgcggagtaccaatcttttacaccactgacaaaagcgttcacatgatattctttgttcacacgaccttggtaactttgtactgccaccgcataagcagtggcataagatttttgatctattttatcattgtccaagttaatcaccgtttttatattgttttccgatgaggtataagaagtaacagattttaccgagcaagctgaaatcagcccaatacataaaaataaagatattcttttaaacataaaattattcccaaagaaaaaataaattaattgtacagacggatcggatttaagccaataaagaaaattcaccgcactttctcatttattctcaacctttaaaacaaaatctaaaaatgctatattgtacgctgttttttctgactaacctcaattatttatggctaattatcaagatataacatttgcccttgcgggtgtgtgccaagcggcaaaattagtacagcaacttgcaatgaacggtacggttgaccaagaaattttgcgaactggtttaagtacattgttgcaaactgcaccggaagatactttagccgtttatggagggcagaaaagtaatttaaaattggggttggaaaccttaatggaacaattaaacggcagtgatgtaactttaaatcgctattggttaggacttttggctttagaaggtaaattacataaaaatgcacaagctaaatctgaactggctcgtcgtattcagtatttgcctacacaacttgcccattatgatttacttgatgaacaaatgctatcaactttagcttctatttatgttgatgttatcagtcctttaggtgctcgtattcaggtccaaggctccccgctttatttacagcaattaatgacacaaaatcgtattcgtgcttgcttgttgaccggtattcgttcggcggtactttggcgacaagttggcggtacgaaatggcaatttttgttttcacgtcgcaagctggtagcaacagcacaacaaatttattcatctatttaactgttcttaggagtaattcttttatgcaattcaacgcattgaccgcactttccccgatagatggtcgttatcaagacaaagtaactgctttacgtagcatttttagcgaattcggtttattgaaatttcgtgtaactgtcgaagttcgttggttacaaaaattatctgcaacaggcactattcaagaagtttcttctttatctaaagaggcaaacgattacttaaatcaattggtagaaaatttcagtttgcaagatgctgaacgcattaaagaaattgaacgtattacaaatcatgatgtaaaagcggttgaatatttcttaaaagaaaaaagtctggcaatacctgaattagtggcgattagtgagtttatccattttgcttgtacttcggaggatatcaacaatctttcttatgcgttaatgttaaaaaacgcacgtgatgaagtacttttacctgagtggcgtaagttgattgatgaaatcactcgtcttgctacagagtataaagcaattccattattatcccgcactcatggacaacctgcctcacctaccacaataggtaaagaaatggcgaatgtggtatatcgcttacaacgtcagtttaaacagttacaacacgtggaaattctaggcaaaattaatggtgcggtaggaaattataatgcccatttatctgcctatcctgagattgattggcatcaatttagccaagaatttgttacctcattaggtttaacttggaatccttatacgacccaaattgaacctcatgattacattgcggagttttttgataatgtagctcgttttaacactattattatcgattttgaccgtgatttatgggggtatattgccttaaatcatttcaaacaacgtactattgccggtgaaattggatcgtctactatgccgcacaaagtgaatccgattgattttgaaaattcagaaggtaaccttggcttagcgaatgctgttatgtcgcatttaggtgcaaaattaccgatttcacgttggcaacgtgatttaaccgactcgacagttttacgcaatttaggtgtggggcttggttattgtttaattgcttatgcggcaacattaaaaggtatcagcaaacttgaggtaaatgaaccgcacttacgtgaagaattaaatcaaaattgggaagtgctggctgaaccaattcaaactgtgatgcgtcgttatggtattgaaaaaccttatgaaaagctaaaggagttgacgcgaggtaagcgtgttaatgcagaggcgatgcgtgagtttattgagaagttggaaattccagctcatgaaaaagctcgtttaaaacaacttacaccggaaacgtatatcggtagtgcaattagtttggtggaaaaattgtaaattcggtgtgtttgtcttggctattgccccttagtataaaagcgtatcttagctacgtaaggggcaaatttaagacacttcaggtaagatttaattcaaaaatagacttttgccggttaagtttaaaaccttctcttattaataattccggttgttgcagattttgttccatgactaaaagtgtcgattgagtataactgacaaattcttttgcttttgcaataagtgcggtgtaaatttcactcttattttgggtatttttgacaaaaatatcatttaattgccaataacgttgcagttgtaatgaagaaaagcgaggatagagttgaataaagccgacagggttttgctgattatcgacggcgagaaagaagatactttcactaaatcgaattcggtttgataaaaaaataagagttcgctccggattttctatcatattatgggtgaggcggtattgttcaaataaagacaataaagcgtccaaattccatagttcagctttaaatattttcatttctcaataattgttcaaaatttatgaaattcatacagtagattttatctttttaatacaaaataatcatcttttatgaaaaaatttttatggatacaggaaaatttttgcaaaaaagagtatagtactgacagaatttttttattaattattatggagaacataaaatggctcgtcgtcctttagtcatgggtaactggaaattaaatggtagtaaagcctttacaaaagaacttattaccggtttaaaagatgaacttaatgcggtgtcaggctgtgatgtggcaattgcaccgcctgtcatgtatttagcggaagctgaaactgcactggtcagcagtgatattgctttaggtactcaaaatgttgatttaaacaaacaaggtgcatttaccggtgatatttcaacagaaatgttaaaagactttggtgtaaaatatgtcattatcggtcattctgagcgacgtcaatatcatcatgaaagtgatgaatttattgcgaaaaaatttggtgtgttaaaagatgctggtttagttcctgtattatgtatcggtgaaagcgaagctgaaaatgaagcaggcaaaacggaagaggtttgtgcacgtcaaattgatgcggtgatgaatacactaggtgttgaagcatttaacggtgcagtaatcgcttatgaaccgatttgggctatcggtacaggtaaatcggcgactccagctcaagcacaagcagtacatgcctttattcgaggtcatattgcaaaacaaagccaagccgttgctgaacgggtaattattcaatatggcggttccgtcaatgatgcaaatgcagcagaattgtttactcagcctgatattgatggtgcattagttggtggtgcatcgttaaaagcgtcagcgttcgctgtcattgttaaagcggcagcgaaagcaaaaaactgattttagttcattcataaaaagtgcggtaattgataccgcactttttagtattcatattagtattcataatttctcgttttcttaatgtctaaaatttatgtggtcttttttttatacctcaataatgtactgtattcagccatttgtcttggtgtataaccttatacgcagttttaagtcgccgaattatcgaaaacgtattttagaacgttacgctttttatccttcgctgactgaaccgaagccgaatggggttgtgattcatgcggcttctgtgggggaagtgattgcggcaactcctttagttaaaaagatacaacagcaatatccacatttatctataacgtttacaacggtgacaccaacgggatcagatcgtgtcaaagccgcttttggtcaatccgtcttccatgtttatttaccttatgatttacctgatgcaattttgcgttttattgattttgtaaaaccgaaaatgtgcattgtgattgaaacggaaatttggccgaatttaattaaacaattatatttacgagatattccttttgttattgctaatgcaagattgtctgaacgttcggcaaaacgctatggctgggttaaagcacaattacaaaatatgtttagtcagattagcctgattgcaccgcaagacgaggtaagcctgcggcgttatattgatttgggctacaatccgtcaaaattaaaattgacgggaaatatcaaatatgacttagtggtgaatgatgaattagtgcaaaaaattaccgcacttcgtcaatcttggagtcaaaatcgcccgatttggattgcggcaagcacccatgagggcgaggaagttattattttgcaggctcatcaaaagttgctaaaaacttatccgcagttgttattaattttagtacctcgtcatcctgaacgttttaaccttgtcgcagagttaattgaaaagcaaaagcttagctatattcgccgttctgcacatgttaatcccgatttattaacacaggttgtacttggagataccatgggggagttgatgttaatgtacggtatttccgatattgcctttgtggggggaagtttagttaagcatggggggcataatcctttagagcctctcgcttttaagttacctgtgattagcggtcaatatacttttaattttccggtggtttaccaaaacttatcagaggttcaaggggtagtgttagtcaatgaaaatagccaagagctggaaagtgcggtaaaaaatttgttatcttctcctgaagtatgtgaacgctatggtaatgctggttatgaagtattggtccaaaatcgtggtgcattacaacgactatttgaattactacagccttatttggagaaagaataatgacaacggttatttatcctggcacttttgatcctattaccaatggacatatggatattattcagcgtagtgcggtcttatttagcaaagttattgttgctgtggcaaaaaacccgagtaaacaacctttatttaatttagctgagcgagttgaattagttcaattgtctgttgttcatttagacaatgtagaggtaatagggtttgatgatttattggcaaatgtggttaaagcaagacaaattgatgcgattattcgaggggtacgcacgacaatggattttgaatatgaatcacaacttgcacatttaaatcgtttgttgacgaatggtgtagaaagtttatttttacccccgaccgagcagtggtcttatgtttcttcaactattgtacgagatatttttttacatcaaggtgatgtgtcccgattagttcctgcagcggtattacgagctttagaaaagcgggctaaataatttgatgagattttattaaataatccttacattatgtatgtttaaaacactaaaactaaataggaaataatgaatgttgaataaaatttttgtgtggtttgaaagtcgtttaaatccttatccggaacagacgttcaatcacctacatcaaggtctgtttcgatttatttggtcaaatttggaaggaatgaaaaaatggattttcctacttgctttcttatcgttcggattgggggcaatggaggcaatccttttccaatttatgggcgttttggtggaatggctcagtcaatatgacgtgcaaactttatgggtagaaaaaggtgcttatttagttgggatgttgattttattgctatttagcattatatggtcttttttagcatcagctacacgtttgcaaaccttacaaggtgtttttccaatgcgtttgcgttggaattttcatcgtttgatgttggggcaaagtttaagtttttatcaagatgaatttgccggtcgagtgtctgcaaaagtcatgcaaacagcgttggcattgcgtgatacagtgcttactttggcagacatgatggtttatattttggtctattttgttacctcaggtattgttttagcagcattagatatatggttattagttccttttgttctatggctaatagtttttgtggttattttatggattgttattcctgaattggctaaaaaagcagaacaacaagcggactcaagatcattaatgacaggtagaattactgatgcttatgccaatatttccactgttaagcttttttctcatggtgcaagagaggcagcttatgcaaagcgatccatgcaagattttatgatgactgttcatgcacaaatgcgtcttgctacttccttagatactctgacttatagcacaaatgtagcgttaaccttaagtacgggaattctagggattgtgttatggggaaaagggttggttggtgtgggtgcaattgctactgcgttggcaatggcactaagagtgaatggattatctcgttggattatgtgggaaatggcacgcttgtttgaaaatatcggtactgtaaatgatggtatgtcaacactgacaaaaccgctaactattgtggataaaccggacgcacaagatttggagattaaacaaggaaatattcattttaataatgtagactttgcttatacaccggataagcctttactaacaaattttaatttacatattaaagccggagagaaagtagggctgattggtcgttccggagcaggaaagtctacaattgtaaatttattactgcgattttatgaaactcagcaaggttctatcactattgacgggcagagtgtcgcagatgtttcacaagaaagtttacgtcgccaaattggtttggtcacacaagatacttctttattgcatcgttctgttcgggataatattgtttacggtcgtccggaagcgacagaagaagaaatggttgaagctgcaaagcgagcagaggcggcggagtttattccatttttgagtgattctcaagggagacaaggttatgatgctcatgtgggagagcgaggagtaaaactttctggggggcaacgtcagcgtattgctattgctcgagtgatgttaaaagatgcaccgattttgttactggatgaagcaaccagtgcgttagattctgaagtggaaatcgctattcagaatagtttggacaaaatgatggaaaataaaacagtgattgccattgctcatcgtttatctacaattgctgccatggatagattaattgtattagatcaaggacgaattgttgagcaaggcactcatactgaattgctggagaaaaacggtttgtatgcaaagctttggcaacatcagagcggtggatttttgagtgaatattagtcaagattttaggattaatcaaagacactaaaaaggcggaaatgtaagatttcaaattccgccttttgctcctcaaacagtgttatttaaatttgtcggcataagcagagctgttgatccactgatgatcttgttcccaagtaaatttccatttacgtacaggtcccgccataacattaaggtaatagttgttataaccggcgatagtggcaactgggtgataaccttttggtaccagcaccacatcgccatcatataccgccatacattcgtccaaagtgcggtcgtccgtatagacacgttgcagagcaaaaccttgtggtttatcaaaacgatgataataactttcttctaagtaagtttcatcaggactatctttttggtcatgcttgtggcttgggtaggaactggtatttccttcatcagtaaatacttcaaccactagcaaggcatctgccttttcggtttccggcaagatattgtgtacaaggcgtttgttattaccaaaaccacgtcgttctactcccacttgttcaggggtaattaaacgtacaggcaagtcaccgttacttggtgctcgacaaacagccaactctaaataagtttcagctttaatttctatttgttgatggtgtggagcgtacaccgaataaggcggaattttctcaaacggtgtagttcgattaccaatattattatatgtttcaccgccagctaagacagtggctttaccacttactaaaacaaaacaagtctcagtagtttctgtattaaaacttaatgtctgccctgcttgcaaatgatacatttcaaaaccgacatattcccaacctgcactttttggtgtgattttttgtacttcaccatttgcagcaggattgtctttgcgtgatttagataataagtaactcatattttccccaaagtgatcatattgataaaattttgccgaaatcataccgcacttagtaaatttcgctatgaaaaatatataaaaaccagatgtagatcacaaaataattattttacttctattagaatttgataaaaatgttttatttatgattttttttgcagtatataaactaggcattttataggatttagtagtatagaaatctttgttaattaaaaataaaggagttttgtatgaacagttttttgcaaaaatatgggtttaccccagcctcattttttcaactcattctgatcactgttaatgcacaattgatttatgctttttgggatattcgtaatagcgtacctggtggttttcctgccgctttaggggtaacggatcaacaagccggttatttatattctatgcaaggacttgtgattattttagggactattgctttaggttgggttggtgaccgtttttcaattcgttctattatgttgctatctacggttggtgtgggtggaatttctttatttctaaccctctcatctccaggacttagcatgcctgtgttactggcttgtttcttctctatgttattttttagtgaggtattatttaaaccggctaatttcaaagcattaagaatttcaaccacggaaaaacatcaaggtatggtatttggattatttgagtttggtcgtgggttgcttgctttccttatctccttgttatggacggtgatgctttattataaagtcggtccgaaggcaatgatgatgacaagttgtattattgttattattactggtattgcagtgttttttattgtacctaaagatcaaaaagtcggagatgaagatactcaagttaatacgaccaaagaagctattcagggtgttgctcgtgtagctaaattaccggttgtttggattgccggaattaatgtgttctgtatttatggtgcgtttgttgccgctgggacctattttgcccgttttttacaaggtggatatggtacaagtgcggttgctgcggcagtttttgcaacagtagttattgcattgagaatgttacctttggtttcttccgttttagtagaaaaagtctttgcttctaccgcacacttcatgcgaatgatgcaaattattttagtggttattctttctgtaattggaattatcttttttaccaatcatccagatatttctttatatgctgatggttatattccagataataccccagtaggactcatttcttccagtatgttctggacactggtagttcttatgttatgtgcatcagcttgtatcttcatgattcgaggtgtttattatgccccaatcggtgagatgggggttgataaaaagcattcctcagcagcaatgtctttcgccattactattggctattttcctgctttattagcaccaattgtattaggtggcttggttaaatcaccggcaaaagatgctacaggacaaattatccgctcttatttaactgatacgcaagtgttagcttgtgctttctttgggcttgcgattcttgcgttaatttctgtttttatgtcacatactttaattaaaatgaaacagaaacagcaattaaaaactagtaatcaataggcggttttttatgaatggtcaaaaaataataggaagtcagtgtattacgcaatgtaatcccgatcttcgcattaccgaattgattattccaggaactcatgactctgccacatcaacgtgttatgaacgttattatcgaacacaggatttatcaatagcggagcaattggattgcggtgttagatttttagacattcgtttacgcaaagaaatggttgcagcccatcgagaatgggttagtgatattcgagcagaggaaatttttgaaaagtgcggtgagtttttacaaaaaaatccacaggaattcgttttaatgcgtattcaaaatgcaaatgaacggaaagatgattttcctgaatatggcgaagcgttgttgtcaaaagtacagcaatataaatctttgttttatgcttgggatcattctcaaattgttcaagatggcaatccaaaatggccaactattgcacaagcggctggaaaaattgttccgatcgaatgtgctccgccaagtatgtcaattaacaaaatagacggtgaattatgggcagccaattggcatgataattcgcagattttgttacaagacttgtgggatggtccgacagtagaagaaaaatgtgtggcaattaaaacgctgattgaaaaaggcagagaggtacactcggacatactgttgttaaatcatattagtgcgactaatggtgaattgcagtatccggatgcttatgcagcatatttgaatgaatactctagtcgattatggaaacaattggcgaaacgtagttttagaggtgtgcagatttatgattttattaatccttctatctgccaagaattgttgcgattaaattttgattagttgagttgatagatttagcaaaaatcaaatctagatcacaaaaatgaaataaatatttcgttttcaataaaatgaattgaaaattttattccattgatctactctaaagacgtagcaagaaatgctttgtgattgagcaaaaatacttaaggagaaaataatggaaacggttttgaactttatcaatggtaaacaagtagcaagtaaaggtactaaagcttggcctatttataatccagccacgggtgagcaaattcgccaagtaatgatgagtactgcagaagaggtaaatgaagcggttgaagttgcacaaaaggcatttcctgcttgggctgcgacttcgccacttcgtcgtgcccgtgtaatgtttaaatttaaacaattgttagaacgtgattgggatgacttagctcgtttaattaccgaagaacatggtaaagttttctctgatgcacaaggtgaactaactcgtggtttagaagttgtggagtttgcttgtggcattccacatttagtaaaaggtgaattttctgaacaagccggtcgtgggattgatattcattcagccatgcaacctttaggagtttgtgtaggtatcacaccatttaattttcctgcgatggttccaatgtggatgtttccgattgcacttgcttgcggtaatacatttatcttaaaaccggcgaaagccgatccatctttatctattcgtttggctgaattattaaaagaggcggggttaccggatggtgtgtttaatgtagtgcatggtgatcgtcaagacaatgaaattttattgcgtgatcctcgagtgaaagctgtaagctttgtgggttcaactacggctgcggcacatgttcatgcgattggttcggcacatggtaaacgtgttcaagcactgggtgcggcgaaaaatcacggtttagtgatgccagatgtcgatattgaagcaacagctaacgcactattaggtgcggcattcggtgcagccggtgaacgctgtatggcattacctttagcagtaaccattgatgatgaaacggcagataaattagtcgcagcattaaaaccgaaagtagaggcattacgttatggtcccggtctcactaaagaaggcgaaaaagaaaatgattttggtccattaattactcgtcaacatcgtgataacgtaaaacgttatgtagatataggtgtgtcagagggggcaactttagtggttgatggacgtgataaattccctaccggttacgagaatggtttctttattggagggtgtttatttgaccatgtaactcctgatatgactatttacaaagaagaaatttttggtccagtattaggcattgtccgtgcgaaaaatttccaagaggctatgaaactaattaatgagcatcaattcggtaatggtgcagcaatctttaccaataatggtgcggcagctcgtgaatttgcatatcaagtacaagcaggtatggtgggcgtgaatgtgccaattccggtgccgatggcattccattgtttcgggggatggaaagaatccgcttacggtgcattaaatgcttacggtccagacggtgttcgtttttatactaaaatgaaaactgtaacaactcgttggccagagaaagatctttcatcacaagcagcattcagtatgccaaccctataaactagacaacagaataaaaatttaagttaatgtaaagaagatagttttttagctatcttcttttgcaagaaaaggaaatgaaaatgaaaaaagtccgagtcggtttaatcggaacaggttatattggtcgttgtcatgcgattgcttatgcacaagcaccgacagtttttcctcttgaggctgaattggttttggaatatttagctgaaatcacaccagaactggcacaacaaaaagcacaagaatttggttttaatcgttcgacaggtgactggcgagatgtagtatccgatccaaatatagatgttgttgatatttgtacccccaatttcttgcacaaagaaattgctttagccgctattgctaatggtaaacatgtttattctgaaaaacccttagcattaaccgcagttgatgcaaaaatcatgtatgaggcggcaaaaaaagcaggtgtcagaacccttgtgggatttaattatattaaaaatccgactacacaacttgctcgtgaaattattgagcgtggcgaaattggtgaagtaatccatttctatggtacgcataatgaagactatttagcatcagatacgacacccttagactggcattgtgttcgtgaaaaagcaggacttggtgcattaggtgatttggcagcacacattgtgcaaatgtcacaatatttagtaggtagcgatattgaaaaagtgatcggtgatatggagacggtagttaaagaacgcccaaatcctcaaaatcttgcagagcgtttaccggtagaaaacgaagatcaagcaactgctatggtgcgttttgcaaacggttgtatgggaaccattgaaacgtctcgtattgcttgtggacgtaaaatgggattgacttatgtaattaccggaacaaaaggtacaattacctacacacaagaacgtatggcagagttaaaactctatcttcacgatgaagatcctgctcgtcaaggctttaaaacaattttgacaggtccgttacacgcagattataaaaatttctgtgtaagtgcgggtcatggtattggttttaatgatcaaaaaacggttgaaattcgtgatttagtgaatggaatagcgaataatcataatatgtatcctgactttgaagaaggttttaaagtttctcgtgtattagatgctattgcacaatcttgccaagaaagacgttgggttaacgtgaaagaaattgcgtaattttcaccgcacttttataagtatttaaaaaggtcgagttgaatgactcggcattttttaggtataaatttaaaatgttgtttatctctaatttttaaaaatttttccctcaaaaagtagatcttgttcacaaaattttaacttcatcattgctctgtatcttgataaatgttacatactgttttaaacaatttatttcaaattgttttatttttggaatttatatttcttcaagtggaatatagctgtatttcagaatagtgattaactcaactttccaggagtagcgttcttatgaagaaaacattattggctatgttatgtggcggtctattattaacctctcaagctgtaatcgcaaaaaattatgtcattggtgcacctatgaactcttttgcggataaatggcaaacttatcttcaagatgccgttcgtgattttgatgaaaaacatgatgatgtgcaaatcaaattggctgattcaaatagcgatcctaatattcaagtcaatttagttcagaattttatcgaccaaaatgttgatgcgttacttgtggttccaaccgatccgacagtagtgaaacgtattggcgtattggcaaaaaaagcgggaattcctttaatcgtggtgaaccgtaaaccaaatgatgagcatatgaaatatgtaaccagctttgttggttccgatgaaattgaaggtggtcgaattcaaggtgattttattgcgaatactctagccggtaaaaatgcagaaagtctcattttacttggaccattgggacaagatgcggtaactaaacgtactcaaggtaatgaggaaatttttgctcagcacaagaatattaaagtagtgagcaagcaagaaggtagatgggaacgtgaccgtggtttagctattgcagaaaacgtattggcggggaataaaggtattaacgttattgtgagtaacaatgatgaaatggctattggtgcaattcttgcaactcgtaagttaggtatcaaagacgaagacattactatcgttggtttagatgcaactcccgatgcgttagagtatttaggtaaaggtttggatgcgacagtattccaatccgcacaaggtcaaggttacaccggagctgaaatggcttatttagcggctaaaggtgaaaaagtaccaagcgttaaatgggttccatttgagctagttactccggataaaaaagaagaatatcaagcaagatataaatagacgcttcttaaccaacacaaagggtagtgtaatacctaccctttatcttgagcaaatgttgatcgttatcatctagagacaaagttatgttcaaaaaatcattgtttgttttattgggagtagcgtcgttgttttcccccattgttacggcaaaaaatttaaccgttggcgtggcgatgtatagtctttcagataaatatcctacctatttgcaagatgctatgaagaaatttgatcaggaaaaagatgatgtcagtttccggtatgctgatgccaattcagatcctgcaagaatgttaagtgatattgaaacatttattgattctggtgtagatgctttgttagttatgccgacagatagcgatattattaaagctattggtgttaaggcaaaaaaggcaaaaattccgttagttgtggtgacaaataagcctaaagatgaggatatgaaatatatcaccagttacgtagggtcagaagagattactggtggtgaaatgcaggcaaactttattgtagaacaattaaaaggtaagccggcaaatgcgattattttaatgggacctctaggttgggatgctcaaattaaacgcactgaaggaaatgaaaatattctgagaaaacaccctgaaattcaggtgatcagtaaacaggaaggtaaatgggatagagcaaaagcaattgatattacagaaaatttgttatcaggtagtcaaaaaattgatgtagtgatcagtaataatgacgagatggcaatcggtgcactccttgcagcccgtaaaaaagggattgcagacgaggatatgttgattgttggattagatgcaacacctgatgcgttagagtatttaggtaaaggtttggatgcgacaatttatcaatctgcttccggtcaagggcgtaccagtgcagaaatagcgtataaagcggcaaaaggtgaaagtgtacctaagttgaactttattccttttgaattggttacaccggataaaaaagcacaatatattgataaatatagatgatagaaaacagtaaaaattaaccgctctttgttgttagaaattaccgttattaatacgacaataaaaataaggagttctaaatgaatgatttgagtcgttctccatatattttagagatgcggaatgtatctaaaacattccccggcgttaaagcattggacggcattaacttaaaagtcaagcgtggaaccattcatgccttaatgggggaaaacggtgcaggtaaatcaacgttaatgaaaattctctacggcatctatacgccggatgccggcggagaattaattttagatgataagccttttaaaccgagtgcaccgattgatgctattcgcaccggtttgacaatggtaccacaagaaatttctccggcagggaatttaactattgcagataacttctatcttggacgagaaattactcgcagtaaattctttttaaatcaaaaagaaatggattgtaaagcaacggaaatcttaaatgaattgggtattccgatggatgtaactgcgaaaatgtcagatgtttccgtagcgaaggcacaattggttgcaattgctaccgcagtttccaatgatgcgaaagtaattatcatggatgagccgacaacggcattaacggaggtagaggttgaacaactttataaaattattgagacggtaaaacaacgagggatcgcaattatctttatttcgcataagttagatgaagtttttcgtgtttctgatgaaatcactgtaattcgtgacggtcaatatgtaggcacgaaaccaacctcagatgtaactaaagatgaattgatttctatgatggttggtcgtgatatgtcagaaatgttccaacgtgaacgtattgcaatttctgatgaagttgtacttgaaattaaaaacttctctcgtgcaggtaaatatcatgatattaactttcaagtgcgtaaaggtgagatctttggtattgccggtttagtcggtgcggggcgttctgagattgtagagggattgtttggttataaactggctgatagtggtgaaatctatgttcacggcgaaaaagcagatattaaaaccccgttagatgctatgaaatacaaaattggctttgtaacggaagatcgtaagttaacaggactgtttttaaatttaagtattactgacaatatgattatgcctagaatgtccccttacttggaaaattttttagtgtcggtgacaaaagcacagaagtcagcaaatgctcaaaaagataaattaaaaattaaagcaccaaatgttgaggtcattaccaataatttatctgggggtaatcagcaaaaagttttattggctcgttggttattacttgagccggatattttaattttagatgaaccaacaaaaggtattgatgttggggcaaaagctgagctttataaactcatggtggaattagcaaaacaaggtaagagtattatcatgattacatcagatatgcttgaattgctttcgatgagtgacagagtgatggtaatgcacgaaggtcgtgtagccggaattattccacaagaagaattgacccaagaacgggtgcttgaattagcatccggtttaggtcaagtataaaaagatttcccctagaataacaatcgaggtatttattatgtcaaatgctacgcttaaaaaaatattgaacgcctatggaatggtgtttattttaattgccttatttttagcattatctgcatcaattgatggtttcttttccgctcgtactgtttggagtattattgagcaagtttctatgtttgggatcattgcaattggggtaacctttgccattattaccacaggtattgacttatcctctggttcaatggtagcgatgacttctgttgtggctgcttctatcgtaaccggtggcgatacagtaagttcggcattacttgcttttgcgatttcaattgtattaggtgctgcaatgggggctatcaatggtagtttaaccgcttttggctctatccctccgtttattgctactttaggtatgatgattattgcccgtggtggtgctcaactttattcttcaggtcgtccaattgatgcctcttctgaatcatttacttggatttctgatgttgatttctttggattacccggtttagtacttgtttatatcgtaattgtcattgcttcacacattttactgagtcgttcaacatttgggcgtcacgtttatgcagttggtggtaatttaaacgcagcaaaaatttgtggtattaatacaactaaaacattgatttgggtctatgttttcgccggtgccttgtctggactagtgggtgcattactggcagctcgtacttatgcaggtaacccctcttatggtttatcttgggagcttgatgcaattgccgcggcagtgatcggtggggtatcgctaagtggcggtattggtacaatccctatgtgcgttatcggtgctttaattattgggacaacaaacaaaggattaaatatgctgggagttgatccatattggcaacaaattattaaaggtttgattattgttgttgcggtattaatcgatacattaaaacgccgtagaaaagcaaattaagcaaaaggttacaagaaaaaaatagcaattgtatagttgctattttttttgtttgttggggaagtgcggttagaaaaatttgatcagctccacaaaaatgaaatttatttttcatttttattttatttgaaacgaaaatatgattatatagctacaaatttcaattatctgatttgggagatgatgatgaagacagtgagattaacggtagctcaagcattagtaaaatttcttgataaccaatatattgagttcgatggaaaggtaacaaaattcgttgaaggcattttcgggatttttggacatggtaacgtgctgggtttaggtcaagcactggaacaggatagtggcgaattgattgtgcgtcaaggacgtaacgagcaaggcatggctcatgtagcaatagggtttgcgaagcaaaaattacgcaaacaaatctatgcctgtacttcatctgttggtccgggggctgcaaatatgattacagcagctgcaacagcaacggcaaatcgtattccacttcttttattacctggtgatgtttttgctactcgtcaaccagaccctgtgttgcaacaaattgaacaaacttatgatttaagtattagtaccaatgatgcttttcgtgcggtaagtaaatactgggatcgtgtaagtcgtcctgaacaattaatgacagcttgtatcaatgcaatgcgtgtattgactgatcctgcagaaaccggtgcggtgacaattgcattgccacaagatgttcagactgaagcttatgattttcctgagtattttttacaaaaacgtattcatcgcattgagcgtatgcctccaacggaagcgatgctacaagatgctttgaccttaattcaaaatgcgaaaaaaccactaattatttgtggtggtggagtgcggtactctgaggcggcagagcaattaaaagcctttgctgaaatttataatattccatttgcagagactcaagcgggtaaaagtgcggtagtttctgagcattatttgaatgttggcggtataggtgtaacaggttgtgtagctgcaaatttattagcaccggaggctgatttagtcattggtattggtacaagatatactgattttacgacgggatctaaatggattttcaataatgacgaagtgaaattcttaaatatcaacgttgctcgctttgatgcttataagttagatggtgtacaagttacagctgatgccaaagaaacgctggaaaaattaaccgcacttttagctacaacaggttatcaagcccaatggggtgataaagtggcacaggcaaaaaaagcgttggaaactgaattagagcgtgttcacaatataacttataccgaagattttgtacctgaaattgatgatcgtttaaatcgtgaggcggtttatgctgaatttatcggtatgactaaatcttgtttagcacaaacgagagtattaggtattttaaatgaaacattaggtgaagatgatgtcatcgtgggggctgcgggtagtttaccaggagatttgcaacgtatttggcagtctaaaggcgaaaatacctatcatttggaatacggttattcttgtatggggtatgaagttagtgctgctctaggggtcaaaattgcagaacctcatcgtgaagtttatgccttattaggtgatggatcttacatgatgttgcattctgaactggtaacgtcaattcaagaaaatagaaaaattaacgtaatattattcgataatatgacaaacggttgtatcaataacttacaaattggccatggtatggacagttttgcaacggaatttcgttttagaaacaagaataccaataaattagatgggggctttgtaccggttaattttgctatgaatgccgcatcttacggttgcaaaacttatcaagtaactaccgaagaagagctacgattggctttggctgatgcaaaaaaacaacaggtttctactttaattgatattaaggttttaccaaaaacgatggcgaagggatatgacagctggtggcacgttggtgtggctgaggtgtcaaataaagctgaaattaatgctgcctatgaagattctgttgctcatattgaggtagcaagacgttactaatttaacttgataggctcaatattgagcccatttatcatgaaattcattcattctttttaagaaggacaacagtatgaaagctgaaaatgtaaaattgggcattgcaccgattggttggacaaatgacgatttaccggaaattggtaaagagaatacttttgaacagtgcgtaagtgaaatggcattagctgggttcaccggtagcgaagtgggaagtaaatatccacgtgatattgacgttttgaaacgtaaactggatttacggggtatccaaatttgtaacgcatggttcagtacattctttgttgatggtaaaaaagaagaaactatcaaaggttttatagagcatcgtgattttttacatgctatgggcgctaaggttattggttgctctgagcaaagtcgtagtattcaaggtcagaaaaaagcaattttcaaagagaaaactattttcacggaagctgaatggcaattgctagcggaaggttataatgagcttgcaaaattagccgcagaaaaaggcatgaaggtatgcttacatcaccatatgggaactggtattcaaacacccgcagaaattgataaatacatggaaatcactaatgatgatgtgtatttattattcgattcaggtcacctttattattcagaaggctcacaacaagttatgttggaggtattagaaaaatatattcaccgtgttgttcatgttcacctaaaagatgtgcgtgatgaggttgtggcggaagtaaaagcaaaagatcttagtttcttggaaggggttgttaaaggtacattcactgtgccgggagatggtgtaattgatttcaaaccgatttttgatattttagaaaaatatgattataaaggttggatggttgttgaagccgaacaagatccggcaattgcaaatccgttagaatatgcaattaaaggtcgtcaatatatcagagaagttgcaggagtttaaaatgattaaagtaggtattattggtgcaggtcgtattggtcgtgtacactcagaaagtattacaaaatatgtaaaaggtgctgaaatcaaagcgatttctgatgttcgtgttactgaagagttaaaagaatgggcaaagggaatgggtattccgaatgtctatgaagactataaattaattttacaagatgcggagattgatgctgttttagtctgttcttccactaatacgcatgcaccgatttctattgaagcggctcgtgcgggtaaacatattttctgtgaaaaaccaattgacgcagatgttgatcgtattcaacaagtattagcagaagtggaaaaagcgggtgttaaattccaagtcggttttaaccgccgttttgaccataatttcaaagcaattaagaatgcggtagtcaatggtgatattggtgaaccccacgttattcgagtcacttctcgtgatccagatgcaccgccaattgaatatgtaaaagtgtccggcggtatgttatttgatatgacaatccatgattttgatatggtgcgttatttgtccggcagtgaagtaacggaggtgtatgcggcaggaggtgttcttgttgatccgaaaattggtgaagcgggcgatattgataccgcagttattaccttaaaacttgcaaacggggcaattgcagtgattgataatagccgtaaagcagtttatggttatgaccaacgtgcagaagtattcggttctaaaggtgcgatccaaaccgcaaatgatacgccgtcaacagcaattttatctaatgtgaatggtgtcatcgcagaaaaaccaaaatatttcttcttagaacgttacatgcaatcttttgctgatgaaatggcgtgctttgttgactcagtggtgaatgacaaaccaacattggtaaacggtactgacggtttgcaaccggtattaatcgcaattgcagcgaaaaaatcattggatgaagggcgtcctgttaaaatgagtgaaatttcctagtttaaggagattgcacgaaaaagggcggtaaaattaccgctcttttggtttgtacttctgttacgttgccaaatctccgaaacagacctgtaatgcggtgattgcactaagtgcggcagtttctgtacgtagaacacgcttaccaagtaaaatttcagtaaatccctgagtttctgtttgactaatttcttgtgcagaaagtcctccttctggacctattaacaagcgaacaccttgtgggggaatttcaggtaaggtacgaattgtatatttagctcttgggtgaagattaagctttaaggttccgtcttgttcagcacaccaatcttgcaatttcattaatgggcgaatttcaggcactatattacgcccacattgttcacaagcggaaatcgcaattttttgccattgttggatttttttctccatacgatccttatcaagttttactccacaacgttcagaccataatggcgtaattatgttgacccctaactcaacggatttttgaatagtaaactccattctttctccacgagaaatcacttgacctagatgaataaataatggactttcacgattgtccaattgacgagagagaatgttaacttcaattgcttttttatttgtttgagtaataatggcagggtaaatatggttacttccgtcaaataattcaatttgctcacctacctgcatgcgtagaacacgccctacatgatttgccgcatcatcgcttaattgacaagtttgttgattttctaaagaggttggatgataaattcgaggaatacgcatattatttaatgggttagttaattttgttgctatgataacagaaattaaaagtgcggtgaaattcaccgcactttttgtcattgtatttgttgacttgaaaaaataagtaattttaccttatttttttatatcaaatttataagaaataaatccatatagcgtccaaccgatgaatgttacgattgaaccgtatagcatagcttgctcacctgctgcgtataaggcatataaactatataacgaaccgatgaaggcaacaaatgtggtaattttagctttatttaatgctactttttctactttaagtaagaccattaatgcagccattgataacagataaggtattacgttggtcaccaccgccaaatctactaagatgttaaattgtttgtttaaagatggactgatagtcatcagtgctaataaactttgaattgcagtaattgtaaccataccaataataggtgcgtttttactggtcacttttttgaagaatgctgggaaatatccttcttcggctgaagatttgaatacttgagcaatggtaaactgccagcctaataatgaaccgaagcaggacattaccattaaacccattaccactttacctgttgtttcttcaaacatatgtgcaaaagctaaaccgaacggtgctgttgaattagcaagttccaaattaggaacaataccggcaattacgttggtggaaacaatataaataaccgccgcacctaatgttccgccaagaactgcgataggaacatttctttcaggattttctactacatcagtattcgcacaagctgactctaaacctaagaatgcccataacgtcatagaaatagatacgccgatggcttcaaaagtgggaacgttatgtgggttccaagcactgacatacatttcaccactaaaccagaaccaaccaattaaacaaatccctacgaccggaataattactccccagatagtaaaagagctgatgttaccagtgattcttgccccaccaaaattcaaaacagttgctaaccatagtgtgaatatagtgcatagtgcaatggatatcggtgataaagtgacatttaatagctctgatccgtatccaacggcggatattgcaatcgcagtattggcaatgactagagaaaccccataagtgtagtttgccataaagttaccggctttaccgaaagaatattccgcataaccacccataccgcctgattttttactgaacataccacattgagcaaaagcataggctaaagcagttgaaccaacagctgtgactaaccaagatacaattgagatagttccaatttcagctaattttgtcggtagcatgataatgcctgaacccatcatatttaccattgtcagtatagtgagttgtactacaccgattttattacttttttgagtactcataattttatccctctattaaagtgcggttatttgtaattaaccgcacttatttttttattatgcttcagttaatacatatccataagcacgtgtacgtccatcaggatctttttgtagatatacgccctgaatttccggtgcgaatccaggaagaacattaatgccttcttccagtgcaaggaaatattgttgtactgtcgtactccaacgttcaccgggaacaacacataaaacacctggagggtaaggtaatgcaccttcggcggcgattctccccacaatatctgtcaatggaactaattcaattttgttacgaacaaattcgatattcgctttttgtgggttcatagcatattccggtagagttgtttttctaaacaagtcacgttgtagctgtttaacatttctactgacgtaaagattgtgcatttcttgacataattgtctgatagtgtagccctgatagcgttcctcattatttttgtacacagtaggcagtacatctttgagtaatgaattttgtttgatatgtttttcaaacgcagctatttgagcaactaaagtttgcatttttgtcaatgtttcagccggtgtaagcaagaataaaatggagttcaagtcacatttttcaggaatgattccattttctcgcaagaagttagcaaggattgttgctggaataccaaagtcttcatattcccctgtttcaatgttaatccccggagttgtgagcatgaatttacaagggtcaacaaaatattgattatctgtataaccctcaaatttatgccatgtatcatttgcatggaaattgaaaaactcaagatcatttgcaatttctttagtatcgtgatcttgccattttttacctttcacataaggaggaataaatggtttgattaaagtgcagtgcttaagcattaactttcttgcctcgataccaacttctacacactcggcccatagacgtttccctgcaggagaaccttgaatttgagcgtttacatccagagtggcgaatagaggatagaatgggctggtagacgcatgcaacataaaggcattattaaagcgtttgtgattgcaatatcttgcttgtcctttaatatgtttgtcttttttatgaatttgtgatgtttgtgagaaacctgcttgttgtttatgtaccgattgtgtcacgataataccagggtcattttcatttaaatctagtaataatggagagcaatctttcatcattggaatgaattgttcatagccgacccatgcagaatcgaacaagatgtaatcgcataaatgtccaatacgttcaacaacctgtttggcattataaattgttccgtcataagtacccaattgaataattgcaagacggaaaggacgtttctcttcaagtttttccggtgccacttctgcgattaattttttaagatatgcttcttcaaaacagtggttatcaataccgccgatgaagccgaatggattacgggcagtttccaagtaaacaggggttgcaccagcttgaattaaagcaccgtggtgatttgatttgtgattgttgcgatcaaataatactagatcacccggtgcaagtagtgcgttacaaaccactttattggaggcggaagttccgtttagtacaaaatatgttttatctgcattatatacttttgccgcatgttgttgagcatcacatggagcaccctcatgtattagtaaatctcccaatttcacatcagcattacaaatatctgaacggaaaatattttctccatagaaatcgtatagataacggccggctggatgtttgcggaaatattgaccgccttggtgtcccggacaatcaaatgccaaattacccatttcgacatattcgcttaacattttaaagaatggaggtaacattttttgctcataaagagacgcagctgtttcaatttgacggctatacaaattgatatcatagctgtttagatcttgaacatgataaacctgatcaaaatattcatcagaaagtgtttcaccttcatttaatacgacaaaaataggaatattaaattcagtcgtttttatttgttgaatatacttaacatcttcggcagtcaatattattgcacctatatcggtgaaatcagtttgatttaataaaactaattcacgagttgatgtaaaatatttttgcactaatgggctatgtgcgatttttaattttaacataaaagactcctttgtcttatttaaagaatacaaatcaccctctcacaataaatatagaaatagtgagatagcttacttttaaagttttataaattattaatataaacagtacgtgaatttttatatttatttaactataaaaaacacgaacacttattctagaattaagaacaaacacaggtttttatttatcaagaaaaaccgtataaagaatataaaaattctaggacaaaatattaataaagtagaaaaccgtgaaatcccctttatttaaagggaattaaatggaaaagaattgatatggattacttttagaatggagaatagcaaaagaaaaacaagaacgatgggacggtttcataaggtgtcgagtacgacgaatatgtgccatcaaagagcgacccttaatagggttatattcttgactataattgtggtctaacataatagcctccgaaatttattttgcttatatagttttagttgactatcgaagcaaattttccgcctataaaataaaaagtcaataaattttattttttttttttttttttttttttttttgatggagatcacaaaaattaaatttttttactattttatgttatgaattattttccttttttgatccaatatttaaatggagtgttttctaaatcactttttaataaattatgatccataaattgacaaaagctaggaatatctctagttgtggcaggatcatctgcaagaattaataatatttctccttcttgcatatggcgaatttttttgcgtaagagcattattggttccggacaacgtaatccaattgtgtttagagtttgtgttacaataatatcagtcataataatttctttgttagaatagaaagcgtgtatgatagcgtccaatttctttagggtcaaaataagcaaagtatgaaatatcttattccccaaagtgcggttgtttttgaagaagaaattaagaagagccgttttattacttatcttcagcatgcagaaggtttggagcaggctaaagcattttggcattcaataaaaaatcaacatccaaatgctcgtcatcattgttgggcaacggtttcgttacaaccaggtaattcgcaaggattagggttttctgacgatggtgaacctagcggtacggcaggaaaacctatgttgaatgttttattgggaagtggtattggtgaaatttctgctgtagttgttcgttactatgggggaattttgcttggtacagggggattagtgcgagcttatggaaatggtgtgcaacaagctttgcaattgttacagacaagtttaaaaatagaacgaaaaatttatcaactttattgtgcgtatcatcaggtcaattggttacatattttatttgaaaaatataatattaggatcatttctcaacattttttacaggatgttcaatttgagttgggtataagtgatgataaactggcagcatttcagaatgacttatctagttattcagcaggacagttaagattattagaaaacaaataagagagaaaattgtgcatattttatctattctgcgtatagtgggaattctagtaacctgcttttccattacaatgttaattccggcttttatagcgttgatttatggagatgggggtggaaaggcttttatcttgtcgtttttttacaatctttcagccggagttggtttatggtggctatgtcgagcacataaggcaagtttacgttcacgtgaaggatttttaatcgtcacaatgttttgggttttgctcagtttattggcagttattccttttatgttgttcgatgagctaacattgagccttgctgatgctgtatttgagtctttttcagccttaactacaacaggggctacagtaattttggggttggatcatttgccaaaatccatccttttttatcgtcaacttttgcaatggattggcggaatgggattgattgtattagtggttgcgattattccattgcttggtattggtagtggtcatttatatcgagcggaatcttcggggccaatgaaagatcaaaaagccttgcctcgtatcggtgaagtggcaaaattattatggtttctctattgtatattgactattttctgtgcgttttcttattgggctgcgggaatgagttggtttgatgcgatttctcatagtttttctacggtgtcaaatggcggaatgtccaattacgacgccagtttaggttactttgataatccggctatttatttgattagtgctggttttatgctgattagtggttgtaattttgctttgcatattcgagcattaactaattggaaataccaacctgtctggaaaatttacgcaagagatcctgaatttaggtttttctgtgcaattcaagggatatttattttcttattatcgttagggttatatttgacctatgaaaattattctgtttttgatgctttctcacaaggtgcgttgcagtcagtatcaatggcaatgacttcaggttatactttatttgatttaaatcagcttccggcttttttggggatgttactggtctttatggcaatattaggaggatgtgcgggatctactacaggtggtttaaaaatgattagagtgcttgttgtatggttacaaatcaaaagagaatttaaacatttagttcaccctcatttggttattccaattaaattggggaaaatgttattggcacagagagttattgatgggatatggggatttttaattgcatttttcttaacctattgggtatgtgtatttgcggttatattatgtggaatgaatgctgctgatgcgatgttgtctgtctttgccacactaacaaatgttgggccaggtttgggaataattagccaaagtttttcacaagttccggataatgctaaatatgtattttcttttgctatggcagccggtcgtttagaaattttttctcttttacttttgtttacgccgactttttggaaatcataatgaaaacattgattttatatttaagccgagagggtcagactaaaaaaatcgcagaatatataggcacaaaatttgaaaaaagtgcggtacaatctttgcttgatttttctggtgatttagctaccttcgatcgtattattattggtgcctcggttcgctatggtcattttgatcaaaaactttatcaatttttgcaaaaaaataccgcacttttacagcagaaagagagcagtttttttggtgtgaatttgacagctcgtaaagaaaataagaatacaccggaaacgaatgtttatattaggaagtttttacaatgtattcggtggaaacccaaatatgtaggggtgtttgccggagcgttgttttatcctcgttattcttggtttgatcggatgatgattagattaataatgaaaataacagggggtgaaaccgatgtaagtaaagaaattgaatatacagattgggaaaaagtagacgattttgtactaaaaattagacaaggtgaatgaaaaatcagcttttgattatatatttgaatttttttgcaaagattgcttgcaaggaagtgataattttctataatacgcctcctcctcttttagaggggaatgagaaatgaatatcatagattatttggaaaaattttaagtaatcacttgacatgaggtttcaatctcactaaaattcgaagccttgcatttttgatgcagtgtaaattgttctttaacaaactatcagacaaactgtgtgggcacttgtgaaactgtattaataagagattaaaagagtaagataagtgcttaaactagagaaattcatagagaaaagatggataaaatagtcagtatttattgagcgaagagattaaattgaagagtttgatcatggctcagattgaacgctggcggcaggcttaacacatgcaagtcgaacggtaacggggagggagattactttctctgctgacgagtggcggacgggtgagtaaagcttgggaatctggcgaatggagggggatagccacgggaaactgtgggtaataccgcgtaatgtctaaggaccaaaggggtgggactgtgaggccacctgccatttgatgagcccaagtgggattaggtagttggtgaggtaagggctcaccaagctgacgatctctagctggtctgagaggatggccagccacactggaactgagacacggtccagactcctacgggaggcagcagtggggaatattgcgcaatggggggaaccctgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctgtgtttgtctcctttgggttgtaggtggtggacctggtggtgttgcattcggattgaaattggcatttggcgattatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaaagagattcaacaaaaactccatttattgagaatagcaggaaataaggctgtacatacttctttctctcatctagatttttcagaagtggcagactgtttgcgtgaagcctatcttttaggaaaatggctctatcttaatcgcgttcctactacttgttaccctgattttatcctcccaagccctaatcacagcattgaacaattgcaacaacatattctttcattaaaagaagaaaataaaaaacttaatgaacatagccaaaaaataatagcagaaaatgcaaaactacatttatcatttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattcgacagtagttttcgttgaaatagagttgattttgataatattacttacttcataccccgacaaaaagtcggggtattacgttttaaatcagcaaagttgctgcttttatgacagcttcaatagctttctgttcagtttgatgaatggtttgttcgtttggaatttcttgttgagtacggtttacgattacacctgataccatacctgcacgcagtcccaaagctgaacacattgtaaataatgttgcactttccatttcatagttcatgacattcaatgcttgccattgttttaatgaaccttgataatggcgacaaacttttccgctataggtatcgtaacgttcttgtcctggatagaaggtgtctgatgaggcggtaatgccgatatgaacactatctccaggttcatttgaaacagcatgatgtaaagcggacatgcaatcaaaatgggcaacagcaggatattctagtggagcaaaatgacggcttgcaccatcaagacgtactgctcctgtggtaataagaatatctcctacgttgatgtgcggttgaattgcacccgttgtaccgattctgaggaaagttcggattcccagttgtgctaattcttctaccgcaatagaaacggaaggaccaccaattccagttgagcaaacaacgacggctttttgacctatataacccaaccaagaagtaaattctcgagttgaagctaaaaatttcggattatccaatagacgagcaatacgttctaccctttcaggtgcacctggtacgatggctaactctgctccatccaataaggcttttgttaagccaagatgaaatacatcagacataaaatattccttttgtttattgtaatatctctcagtataaagcacctctgcaatttcatcaattctttcctgttggtataaaatatgggaagatacaatatgagtgttaaggttggactctaatcttctataagattagaatattccttgaaatataattccacctgttggtagaaaaattgattttttcactgctctttttattagtatttatttttaaaatatcggtaaatgagtatatcatagagtatgtttttatatatttttcatattattttggactatggatataaaattacatttaaatgcaactacgaccccaaaaattcgagcttatttacaaaaatcagataaatcagatcttgagttagcagaacagttaggcatttcggttcaaacggtacgtcgttggagaaataggcaagatgttaatgatcgttctcatagaccgaaaaaaattaatagaactctttcttttgaacaggaatatttgatttgctacctacgaaaatatttcgctttatctttagatgaacttcttgaagctggaagaaatctaatcaatcaaagagtatctcgagcagttattagtcgttgtttaaaaaaatatggtctaaatattgctaataagaaagatttaccatctcaagttggttgtacttttttggcaatgtttcccctgcctaaagagatttctaaagaggaagattatctttttattctaatagagaaattgacaggatatatcagttgtgcttgcttggacagaaaactacagcgtcaacaaagtattatcaattactttaaatctagtttaccttatgaaattcaagagattgagttagccgaagatattactcatcatgccatagtacaggcttttgccaaaaagactaaagtagttacgtctaccttaattttgcaaagtgcggtgaattttgaacaagattttatacggttagtatcaggttattacactgatagcagattaggatttgatgcacaactattaagatatgaagagtatctgaataagcatcttaaacgaaatcgcttaaaaaaactgtccccttatgattatcttatgaaatatcgccggtaggacagttagtttttttatttttttcgatatagctcaataaattctttgatgatgtccattaacaaaacagcattcattacatgatcttgtgcatgcaccataataatagtgacgggtagtttcccctcaccttcatcctgtccgatgagttctgtttgagcgtgatgtgctgctaacaaagcatcatccgcctgtttaagtaatctatctacttcctcaaactgctgttttttagcatgttgtagtgcttccattaaagcactacgacatattcccgcttgaagaattaaattcatcaattgcatttcaagttgctcactcatttttcctccaataaagatagtgcttgtgctaaaattttttctccatcggtcatgccataactcatcatatcaatacaagcgacaggtttgccgaattctgcaccaatagtttggcattcttgcagcttataggaaatttgaggacctaataggacacagtcaaaatcttgtattaatgaatgaaagctttgcatacccttagcttcaatttcaacgggtaaaccctgtgcttcagctgcttgtttcatacgtttaactactaagctggtggacatgcctaaatcacaaataagtaaaattcttttcattttttctccctattttgaaacattatttttcagaaattgataaagtagatgtaatggtttaccgcttgaatagattccttgatctctaaataaggttgtgccgctaatatctaaatgagcccaagtgcagtcattaacaaaccgactaaggaaatatcctgcggaaacacaaatcgccgcattatttggcggagtgttgcaataatctgcaatatggctttccacttggccgagaaatctatcatcacaaggtagttgccatatcgcctcttgtgtttgtattgcggctaaattaagttgatgtagaatttctgtattatttgtcatcacaccggaaatatcataaccaagtgcttttacaacagctcctgttaaagttgcaacatcaataattactgagggtttttgttcagctgcgaatgataataaatcagctaaaattaaccgcccttctgcgtctgtattaataatttcaatagtttttcctgaataagatcggacaatctctccggggcgcatcgctttttcatttatcatattttctgctacaccgacaataatacgtatgttaataggcaatgaattttctacaacggtttcaagtaagccaattaataaggcagcaccacacatatcatatttcatggttttcataccatcgcctgtttttaaccataatcctcctgtatcaaaagtgatacctttaccaacgaaacaataggtctgattacaatcaggggagccttggtaatcgacttgaattaaaaaagggggatgtaaaccgcttttacctacggcatataaagtgttcaaaccatggttttgtagctcttctgcatctaagcttcgtatggaaagttgagatttatgtgcataactgtttaatttttttgcaatatattcaggcgtcgcaatatcgctaggcagatctgaaatttttctggctgttatcatacccaatactattttgcatagttctaaataattattcgatagttgccgcttttgctccggtgtttccactataacaccaaattcaggcgatgcggcggtctctttaaaacctaaatattttggatggtaagaaaggttgagataactaataatcaattgttcattgatctgccgttctaattttacggtttcttttccccaatgtaataagattctttgtgcatctgagtgtgccattttttccatcaaaaaatgacgtattttccccattaagtgtgggttttcagccacttcttttttagaaaaaggtaagctatataagccggcattcgatatatttctgcctatctcgattttgctttccatgtccagtatagaaagcagaggtttcaagcagggttgttgctgtaaaaaatctcgatcttctttccaaaaaaacaacaaagcgttttttatctctaattgggtttgccaatcataaagcggaaattcaatgttcattttaactctccatgaatgcggtcaagataagcttgtagccaactttctgaggccggttcatattgtgtaattccattttctcgtttagccagataaatgatagggttatattgctctgttgatacgacaaaggaaaaattatcaatattagttgatacaccgaactctccttgcatattcatacatacaaccgacaaatctcctgctgttccgtaacgttctaataatcgtatttctaattcattgattgtcgcatcagcagcttgttgtggtgtcatcccctctttcatttttcgtacaatttcataactggtacagcctttcattaagtcttcccccagacctgtagctgttgccgcacctatatgggaatcagcatagaatcctgaacctgagataggcgaatctccaactcgcccatgacgtttcataaataacccactggtagaggtacccacacaaatattattatttttatcaagtgcaataatgcccaccgtatcatgcccggaatatggacttaatccacgaccgagagtttcttgatagcgtttttcataaaatgttttaacacggggtgttagcatatctttagcaggaaagcctttctttaatgcccatttttcagcaccgtgacctaccaaaaaactattaaaacgttcatgacttaatgcttcggcaacgagaattggatttgcgatattacgcaagccggctacagctcccaatgccagagaagttccatccataaaggcagcgtccaattcgacatctccctcttcattgggtaacccgccataaccaacagatttatatagagggtaattttctacttgtgtaaccgcagttaaaattgcatctcttgcacttcctttgtttttaagtaattcaactgcctgacaaagtccttcaaatgccatacgccaagttgcaatcatcccccatcttgaattattcatttatacttgtccttctttcattcgatattgcttatcaataatacggaagaatggtaaataaatcattgcagcaatgaataagttgattacttgtataagtgcgccggaaatatgcccagttacaataaaaccacttaaaacaggcggtaatgtccaagggatataaactccggttgtcgtcgcaacaatatccaaatacattgcaacatactgtactgtagtaataactaaaggtgcaagattgaatgggataagcataattggatttaaaataacgggcagaccaaataagacaggttcgttgatgttaaataccgatgagccggcagctaaacgtgacacttttttagcatgttggctacgggcaaaaataagcattgctaagactaaggcgagagttgaacctgaacctcccataaagatcatatcaaagaattgttcggtaatcacatgaggaggggttaatccattttgcattgctgccaggttttcagcttgattatctaaccagaacggtcgtaagattccattaaccattgaacctgaattgattcctaccgaccataaaatatcgatcatgaatacggtcagtaatgcaccaatataagaagtaccaaaatggcgaattggtgtagccagcacggtatatacaaattcatgaatagtattatattcagttttcgagaataaaatccgaatgcctaatactaaaatcataatcaataaagccggtatgagagctgagaatgactgttgtactgccggcggtacgccgtcaggcattttgatcacaatatttttgcgaatgagaaaggcgaataattcggtccaaatgattgccccaagcatagcaataaataacccttttgatcctaaccattgtgttgaaataactgaaccgacgttttcaactttaacaaaaggagtcaaaataaggaaagctgagagagataatataccggaggaaagtttatctatatttagacgttcagcgagtctataggcaaccagaaaagcaataaatatagacattgtagaaaaaacagcattaaagggaatttctatgatattatcccaaccctttccaaaggttgcggtcatgaaatctttatagctttgagatggaaatgaactaattaccagtaaaatagaaccaacaatgataaaaggcataaacgaaatataagcatctcgaattgctcctaaatgacgctgttgggctaatttaccggcagccgccatcaatttattttcaatttgtttaagcaaggacataataacctccagtaagtaagaaattacaaaacttattgtaggtgatttttgtttgaaaaaagttgataaagatcacaaaattaaaaaagtatcatatgattaattttattttaatgtacatattattagaatatatttaattttttaaatgtttaatgatgtgatacattttttgaggtttgtatggatatagaaatatgtattgataatattgagtcagcattaattgcacaaaattcaggtgcggctcgtttagaagtatgtggatgtttagcgttaggaggggtaactcctccttatagcctgatcaaaacagtattggatgtgtgtaacattccctgttatgtaatgattcgtcccagatccggagattttttatttaatgcacatgaaataaaaatgatggagcaggacatccacattgcgaaacagttaggagctcaaggtgttgttattggagcattaactgaaaatggtgaaattgatttatcaatttgccatcgtctaataagtgcggctgaaggtctgggtgttacttttcatcgtgcttttgatctttgtaccgatccttatcatggtttagaacagcttgttgaattagggtgtgagcgagttttaacttcaggacagcaaaggacggcatttgaggggagatatgttttaaagaccttggtacaacaggcaaaaggacgaattaagattatggcaggtgccggcgttaatccaaataatgccttagacttggtaaaaaccagtaaagttgatgaattacatttatcagccaaaacttttcgtcagagttcaatgaaaggtaattccagtgtgacgatgggaaataaagcagaagatgattacaaaatttggacaacagatcgaaatcaaattattgccataaagaaacttttctaagaatagaggggcataaattttatctggagagcggtgaaaaaaacaaaattttcaccgctcttttttcattattcaaccaactaattttgccgtgaaaatattactaataaccacaacatttttagagaaataaggtagaatacgcccctatttatttttataaagagctttgttttatttatgttatttgcaattggtcagcgttggataagtgaaagtgagaatagtcttggtttgggtattattacgggacaagataatcgtaccgttaccatttcttttcccgcctcggatgaaatgcgtatttatgctttagcaagtgcccctttaactcgagtattgtttcaaaaaggtgatgagattacacaccaattaggttggaaagcaaaagttgttgatgtcatgattcgcaatgagttggctttttatcttgtgcaacgacttgataataacgaagagattgctgtacaagaaatggaattagctcaccaaatttcttttagtaaaccgcaggatcgcttatttagtacacaaattgaccgcaatgagcattttgtattgcgttacaaggcactaaaacaccaacaagaacaatttcagtcctctttaagaggattaagaggaaatcgagccggtctgattcctcatcaattacatattgcacaagaggtagggcgacgtatcgcaccgagagtattattagccgatgaagttggtttggggaaaacgattgaagcgggtatgattttacagcaacaattgcttgctgaaaaagttcagcgagtgctaattttggtgcctgaaaatttacagcatcagtggcttgttgaaatgctacgtcgttttaacttgcatttctctttatttgatgaagaacggtgtgctgattttgataatccggaagatcatgttgaagcaaatccttttgttgctgaaaacctaattatttgtgctttagattggcttgttcaacaaccgaaacgtgcaaaacaagccttggcgggtgagtttgatttattgattgttgatgaggctcatcatctcacttggtcggaagattcgccaagcatagcttatgaattggttatgcaattaagtgcggtgattcctgccgtattattattaacggcgacaccggagcaattggggcaacaaagtcattttgcccgtttgcatttattggatcctaatcgtttttatagttatcgggcttttgaaaaagaacagcaacaatatcaacctgttgctaaagcagtacaaagtctgttatcagagcatattttaacagttgaagaacaaaatcatttagcagaattacttagcgagcaagatatcgagccaatgctcaaagtgattaattctcaagctgatacggaacaaaaacaggttgctcgaggagaattaatgagtaatctaattgatcgtcatggaaccggtcgcttgttatttcgcaatacaagacaaggtgtgcaagggtttcctcatcgtatttatcatcaaatcaaattagatttaccaacacaatatcaaaatgcgattaatgtgttgaagatgttgggggaaataaaagatccagagttattttatcctgagcaaattttccaaaaaatgaatgcggatgcaacttggtggcgttttgatcctagagtggattggttaattaatttagttaagagtttacgtgaagaaaaaatcttagtgatttgtcaagatgcgataacagccatacaattggagcaggcattgcgagagaaggaaggaattcgtagtgcggtatttcatgagaatatgtcgattattgaacgagatcgtgcctctgcatattttgcacagcaagaagagggtgcacaggtattactaagttcttcaatcggttcggaaggtcgaaattttcagtttgcttgtcatttagtgttattccatttgccgaataatcccgatttattggaacaatgtattgggcggttagatcgtataggtcaacgtcgagatattcaaatttatgtcccttgttttgctgatacaccgcaaattcgcttggctcaatggtaccatgaaggtttgaacgcatttgaggaaacctgtccaatgggggctattttgcatgaaaagtgcggtgcaaaattgacagaatttttaacttcagacacaacggacgattttcaggcttttattcaacagactcatcagcaacaattacagctaaaatccgagttggagcaaggtcgagatcgtttattggaacttaattccaatggcggtgagcaggctcaacaattagcgaatgatattgcgatacaagacggttcaacagagctcattgatttcacattgaacttattcgatattattggtgttgagcaagaagatcttggcgaaaaatctattgtcattagcccgacaggaacgatgcttgtccctgattttccgggtttaaaagaagaaggggttactgttacttttgatcgtgatttagcgttggctcgtgaagatcttgagtttcttacttgggatcacccaattgtgcgtaatgggattgatttaatcgtcagtggtgatataggtaaaagtgcggtggctttattggtaaataaacaattaccgaccggtacattgctacttgaattagtttatataattgagagccaatcaccacgtggattacagttgactcgctttttacctccaacaccgctacgtttacttcttgatattaaagggaatgatttaagtcatcaaatttcttttcagggcttgcaaaaacaactgaaaccaatgggtaaaaatatggcaacaaaagtcattaaaataatgcgtccagcgattgagcaattaattaagcaaagtgcaaaaaatgtagttgagccagctaaaatgataattgaacaagctaaacaactggcggatcaatcattgagtgcggaaataaatcgattatatgcgttgcaggcggtcaataaaaatattcgtccggaggaaattgaacagttagaaagtcagcgtacgttatctcttgaattgcttaatcaagcaaattggcgtttagacagtttacgggtaattgtgagtaataaggaataacatggcattaattgattatcgtccccctttagaaccttatttggacattgtatatcgtgatgatcatattctcgtggtgaataaaccgagcggcttgctttctgtatccggtaatcaaccgcaatattatgatagtgcaatgtcgagggtgaaagaaaaatatgggttttgtgagccggcacatcgtctagatatggcaacaagcggcattttgctttttgcaatgagtaaaatggcagatcgagagctaaaacgccaatttcgtgagcgtgaacctaaaaagcattatcaagcactcatttggggacatttgacgcaaaataccggcacggtgaatttgccgttgatttgtgattgggagaatcgcccaagacaaaaagtgtgttttgttcatggcaaaagagcggtaacaaattttaaagttttgcatcggtttgaaaataatatcactcaagtcagattaacgcctattaccggaagatcccatcaactgcgtttacatatgcttgcattaggacacccaattttaggggataaattctatgcacatccacaggcaaaatcgcttgcaccacgtttgtgcttacatgcagaatttttacaaataactcatccgcgtacaaagaaagtgattcagtttagcacaccggcggattttccgatttgagttgctagcataaataatcagcccttaatctatatgattacgggctgtgtgtttataaggaactattgtctatttttataatactcaatagcttgtggcattaattttaataaattcgcttggcgagcatcatcggtggggtgagttgagatgagcttatccagcaaaccttttgaacccacggaggcttttttcattttttcccacaattgtggtgctgctttaggattgtagcctgattttgccatcaggaataagcctacttcatccgcctcttcttcggcactacgtgaataaggtttatttaagccccaatccgcagcaagtccgacaatcagtccacttgcgtcagtgccaaattttgttgataaagcaacatgagcaacttgtgcaactacattagtgaacgtacccaaattcgcttttttcttaccatgttcttttaacgcatgtgccatttcatgccccattactgtagcaatttcatcatcagttaattttaagttgtcaactaaccccgtataaaacaccattttgcctcccggcatcgcccaagcattcatttcttttgatttgataacatttaattgccatgtaaaaacttgcccggtgttgttttctttatctgcataagggcgcatttttttaaaaattttatgtatacgttttgccgtcggtgagcttttatcaaccactccttttgcttcagcttgcccgattatctgcacataacttgaggcagactgttgattaatcgaagatgaatctgcacaagcattgagcagtaacacagtaaatatgacaaaaataatttttttaatcgacataatgatatttaaactgttaataaaaaaccgctctttgagtaagagcggtttttagagattattttttagcacgttcgaatgattctaaaatttcttggcgagctgattcaacaccttcccaaccgtcaactttaacccatttacctgcttccaatgctttatagctttcaaagaagtgctggatttgtgcttttaataaagccggtagatcatcaacatctttaatataatcatattctttacttaattttgtgtgcggaacagctacaactttcgcatctccaccagcttcatctgtcatttttaatacaccaactggacgacaacggattacagaacccggttgtaacggatatggcgttggtactaatacatccacaggatcaccatcagaagaaagtgtattatttacataaccatagttcgccggatagaacatagcggtcgccataaaacgatcgacaaataatgccccactttctttatctacttcgtacttgattggatctgagtttgccggaatttcaatgacaacataaatatcatccggtaacgctttaccggcaggtacattttctaaacccatttttcttttccttttacatgttattgatgaatcagattgcggaattatagcgttatttctagggaattgtcgagttatcaacaaagaatcttcttactgaaaaaagtattgtaaaaaagttttgaactattataatagtgcaaaattcaattttcaaaatgaggatctattatgacaaaaaaaatcccttctttatttggtggtgcaatgattattgccggaggaactatcggtgcaggaatgttagccaatcctacttcaactgcgggtgtatggtttttaggttcaacattaatcttaatttatacttggttttgtatgacaacatcagggttgatgttacttgaggcaaatctacattatcctactggtgccagttttgatactattgtcaaagatttattagggaaaggttggaatttgattaatggtgtgtccgtcgcgtttgtactttatattttaacctatgcttatatcacttcaggcggtgggattacgcaaggtttttttaatcaattgttaagtagtacagaaagtgcggtagatattgggcgtagttccggatcgcttatcttttgtattgtgctggcagggtttgtatggttttccattaaagctgttgatcgtttcagtgtggtattaattgcaggaatggtcatttcctttttcctctctataaccaatcttgtcggctcggtgaatacagaaatattgttaaataccgtacaaggtgaacaacaatatttactttatgcgttagccgcattacctgtttgtttggtttcttttggctttcatcaaaatgtaccgagcttagtgaaatattatgatcgcaatgcaagtcaggtcttaaaagcgattttcatcggtacaagcattgcattagtgatctatatcttatggcagttggctattcagggaaatttaccaagagctgaatttataccagtcattgaaaagggcggtgatatttcagcattattagacgcattaagtaaatacttacaaacggattatatagcacttacactgaaattttttgcttatatggcaattgcaagttcattcttaggtgtaacgttagggttatttgattatatcgctgatttatttaaatttgatgatagtgttgctggacgcactaaaacagcgttaattacgtttttaccgccattattattgagcttacaatttccttacggctttgtattagccattggttatgctggtttagcagcaacaatctgggcggtaattgtaccggctttattagcgaaagccagtcgtaagaaattcaaaagtagcagttttaccgcttacggtggaaattttatgatatatttcgtcatcgcatttggtttattaaatatcttcgcacaacttgcaatgcagttcggttttttaccggagtttagaggctaaatagcttgaaaaagtaagaaaaataattatcttgttaacgtatgctttatttggcacccactgtagatacgtgggtgcttttctgtaaattttcctagtattagctttgatttgtttgctatagtaggcacaatttttagggagtattgtaggataaaaatggcagaaaaaatcattattgctgaacatcagtttatgcgtacgatttctcgtatttcccatgagattatcgaaaaacatcagtcgcttgatgatattgtgattgttggcattaaacgtcgaggtgctgaacttgccgagttaataaagcgaaaaattatagagttcagtggaattgaattgccctctattgatttagatatcactttttaccgtgatgatttagagtatgtggatcaacagcaccaattgcctgtttatagtggagcatccaattatattaatatccagaataaaacagtgattttagttgatgatgtgttgtttactggtcgtaccattcgagccgcacttgatgctttagttgattttggtcgagcggctaaagtggaattagtgatttttgtcgatcgtgggcatagagaattaccaattcgtgccgattacgtcgggaaaaatattcccacaagtcgtagtgagcaagttcaggttcgcacaatgcaatttgatgatcgttatgaagttgccttggtcacaaaataacatttgtgaaccttttgcaaaattgctactctaatgaacaaatttacaaacgtcttacggaatgaaaaagcggaataaaaaaatgaaagtatttaatttcaaagcagtgttgttttcaataattggtctacttagcattacgataacagcacaggcggctgaaagggtagtggctaccgttgatgggaatcctattttagaaagccaagtaaaaaaggtgttgggaaaacgagcaaataatgaggaaaatcgtcaaatagctttgaatagtattattgatgatttactagtacaaaaagctattcaagagttaggaatcaaggttgctccagcacatgtagacagtgttatcgaaaatattgctgcacaaaatggattaacctttggacagtttcttgatgtcttagattatcagggcattaattatcaggcgtatcgtcaacagattgcctatcagattttaatatctgaagtgcgtaatcaagccattggcagtagcgtgaatgttacccgtgaagaaattcaagacttaggactaaaactatttaaacaagcgaaaaaacaaggaaaagagaaaaaagtaaccgcacctgaatataatgtacggcatattttgttaaaattgaatcctctgctgaatgatgcacaagccaaagcaaaattaactcaaattcgtgcagatattttggcgaataagataacctttgcggatgccgccttgaaatattctaaagattatctttccggtgcagatggtggaagtttaggttttatgttccctgaagcctatgttccagagtttgccaaggttatccgaacatctaaaaaaggtgtgatttcgacaccatttaaaacagagtttggttggcatattttagaagtaacggatattcgcaatgcggatataacgagagaagcttatatgcaagaagcatatcaacaaattgtgaatcaacaattgcaagaggcatcaggcgactggataaaggctttgcgtaaacgagcacatattcaatattttaattaattatgagatcccgacgcaaagtcgggatttttgttttataataccgccaattttttagcattcacactttcacttatgaagtcaaaaacacatttaggacatactgctcgtaaacgttttgggcaaaatttcttgcatgataataatattattcaaaatattgtgatggcaatttatccacaaaaagaacaatttcttgttgagattggtcccggtttaggtgcgttgactgaaccggttgccgaaaaagtagagcgtttaacggttattgagttggatcgtgatcttgctgaacgtttacgccatcatccatttttacatcaaaaattaaatgtgattgaatatgatgcaatgcaatttaattttgaacagctttatattgatgaaaacttggctgagaaaaatcagaagttacgtgtatttggtaacttaccttacaatatttcaacacctttgatgtttcatcttttcaaatatcatgcaattattcaagatatgcactttatgctacaaaaagaggtcgttaaacgtctttgtgcagcaccaaacagtaaagcttatggtcgtttaactatcatggcacaatatttttgccaagtattaccggttttagaagttcctccgaccgcatttaaacctgcacctaaagtcgaatcggctgttgtgcgtttaataccacataaagaattaccttatccggtgaaagatttgtactggttaaatcgtgtgactacacaagcctttaatcagcgtcgtaaaactttacgtaatgctttatcaaccttattttcggcggaaaaattaaccgcacttgcaattgatttagaggcacgagccgaaaatttatctattgctgattatgcaagattggcaaattatttagcggataatccgccaacagaagatctgcaatcggagtaaaaatccaagacaaaactgcaagagttaagataatagtcaatgacaacattatggcaacttatttagtcggtgatttacaaggctgttatgacgaattacagcttttgttagagacggttcaatttaatcctgtacaagataaactttatcttgttggtgacttagtagcacgaggcgataaatccttagaatgtttgcgttttgtaaaatctttaggggcggcggcacaaatggtattgggcaatcacgatttgcatctgatttcaaccgcacttggtattaaaaaagtaagtttacaagaccatgtcgaagcgatttttacagcaccggattttgttgaattaattgattggttgcgacatcagcctttacttgttcatgatgaaaaatgtgattttgtcatgagtcatgcgggcatttcgcctgactgggatttggataccgcaaaatcttgtgcaagagaagttgaaaatgaattacaacatggtgattaccattatttaatcagcaatatgtatgataaccaacctgatcgttggtctgccgatctgcaaggtttgcaacgtttacgttatagtatcaatgtatttactcgaatgcgtttttgctacagggatcatcgcttagatttcgcttgtaaagcgtcagtagaaaaagcaccgcaagaacttatcccttggtttaacttggataatccgttgtttaaagtacaaaatttggttttcggacattgggcaagtttagtggatacacctacaccggcaaatatttatgctcttgatacaggttgtgtttggggtaatcgtatgacgatgttgcgttgggaagataaacagtattttgtgcaaagagcggtgaaagattatttttgaaatggtaactgtgcaatnnnnnnnnnnnnnnnnnnnnnnnnnnnnnnnnnnnnnnnnnnnnnnnnnnnnnnnnnnnnnnnnnnnnnnnnagtgtgcgattgtattgtatgtaacgatttttccttgttgccacttaagaatttccctgttaatttctccggttttaagctatcctataccacattttctatatctaatttgaaccgcactttccattattaataagtcttttagtcaggtttttagcggaaaaagagcggtaatttttcatataaaaggtaatattatgcaagaacaatatcgtcctgatcttatcgaagcacaagtgcaaaaatattgggctgaaaataaaacattcaaagccgtcaaagatccttccaaagaaaaatattattgtctttccatgtttccttatccttctggtcgtttacacatggggcatgttcgtaactataccattggcgatgttatctcccgttatcaacgaatgaacggtaaaaatgttttacagcctatgggctgggatgcttttggattgccggcagaaggtgcggcaattaaaaataaaacggcaccggcaaaatggacttatgaaaatatcgaatacatgaaaaatcagcttaaagtgttgggcttcggatttgactgggatcgtgaaattaccacttgtaaacctgaatattataaatgggagcaatggttttttactgagttgtacaaaaaaggattggtttataaaaaaacctcaacagtaaactggtgtccgaatgatgaaaccgttttggcaaatgagcaagtacatgaggggtgttgttggcgttgcgatacccctgtggagcaaaaagaaattccgcaatggtttattaaaattacggactatgctgaacaattattaagtgatttagatcagcttcctgaatggccggatatggtaaaaactatgcaacgtaactggataggtcgctccgaaggggttgaaattacctttaacgttgatcattcagatcaaaccttaacagtttatacaactcgtccggacactttctacggcgtttcttatttagcggttgcagcggcacatccgttagctgaaagtgcggcaaaaaataatcctgaattggcggcttttattcaagagtcaaaaaataccaaagtggcagaagctgaacttgccacaatggagaaaaaaggtatggcaacaggattgtatgccgttcatccgattacaggcaaacagttaccgatttgggtagcaaactttgtgttaatgcactatggtacaggtgcggtcatggcagtgcctgcacatgatcaacgtgattatgaatttgcccaaaaatatcaattaccgttatttcccgtgattaaaccggcggataattctgaattggatctttcaaaacaggcttatactgagcagggtatcaccattaattctgccgaatttgacggtttggattttgaggcaacctttaacggtattgcggataaacttgaaaaaatcggtgtaggaaaacgccaagtaaattatcgtttacgtgactggggagtttcccgtcaacgttattggggagcaccaattccaatgctgacactggaaaatggtgatgttgtagttgccccattacaggacttaccaattgttttgccggaagatgtagtcatggacggagtaaaaagtccgattaaggcagatcctgaatgggcaaaaaccacttataacggacaagtagcattaaaagaaacggatacctttgatactttcatggaatcttcttggtactatgcacgctatacctctccacaatatcaacaagcgatgttagatgcagatgaagcgaattattggctaccggtggatcaatatattggtggcattgaacatgcaaccatgcacctattatatttccgtttctttcataaattgttgcgagatgccggtttcgtaacttctgatgagccaagcaaaaaattactgtgtcaaggtatggtacttgcagacgcattttattacaccagcccaaccaatgagcgtatttgggtatcgccgacaaaagtaacgttagagcgtgatgagaagggtcgtattatcaaagctgttgatgatgaaggtcacgagcttgttcacagtggtatgaccaaaatgtctaagtccaaaaataatggtattgatcctcaagaaatggtggagaaatacggtgcagatacagtccgtttatttatgatgtttgcttcaccggcagaaatgacactcgaatggcaagagtcaggagtagagggggcaaatcgtttcttacgccgcctatggaatttagtttttgaatacaatcaaaatccggcacaaaccgcattagatcctaccgctctttcagtcgagcaaaaagcattgcgtcgtgatgtacataaaactattgcaaaagtgagcgatgatattggtcgtcgccaaacattcaatactgcaattgcggcaatcatggaattaatgaataaactcaccaaagcatcattatccaatgagcaagatcgtgcagtaatggcagaagcattgaatgccgttgtacgtatgctttatccgattacaccacatatttgtttccaactttggcaagacttaggtaacgaaagtgcgattgattttgcaccttgggtgatagccgatgttgaagctatggttgaagatgaaaaattggttgtgatacaagtgaatggtaaagttcgtgctaaagtaaccgttcctgctgatatgtcggaagatgaaattaaacaagttgctttagcagaagaaaatgtacaaaaattcttgaatggtttaactgtagttaagaccatttatgtaccgggtaaattatttagctttgtagcaaaataagaaaacataaccgcacgtgaaagtgcggttcaatttaggggagtttttatgttcaaaaaaattaaaatagcattactgggtgttggcattttgcttattagtgcttgtggatttcattttcaaaatggtgaactaattccaaatgaattaagaacattggtactggaaagcaacgaccctcacagtaatatgtcaattgcactacgtcgtcaattacaagctaacaatgtgaatatcgttgataatcaaaataatgccactgttttgcgtctaaatagcacaaaaaatactgagcaggtagcctcagttttcaagcgaggttatgaagcagagaaaattttaaccttagaagtatgggcaacagtgagtttaccgaataaacaaagctatccgatttttgctaatgtcaaccgcactttctttgataactctcgtgccgcattagcaaaatcagcagagaaggagattatttggaatgatatgcgtgaacaggcagcccgccaattaattggcaaaatgattgcattacaaacgcaacttcaaggtaaataatgaaccgcatcttttccgaacagctccaattatcactcaataaacggttgtccactgtgtattatttggttggacaagatcctttattgctgactgagagcctagatgcaattgtacagactgcgatattccaagggtttgatgaaaagttagaaattactgtagatcataccactaactggcgttctattttggaacaggctcaatctatggggttattctttaagcgtcaaatgctgattttaactttacctgaaaatccgaccgcacttatacagcggaatttacaagaactgataacgttacttcataccgatatcttactgattttacagatggcgaaacttactaagccaatggaaaaacaaacgtggtttgaattagcaggacaaaaagagcctcaagctgtgttagtgaattgccaaacaccgactgtcgaccaattgcctcgttggatcagtcagcgtgcatacagtatgaaattagagattgtgccggaggcgataaatctgctttgttatagctatgagaacaatttacttgctttaaagcaggttttacaattgcttgatttgctttatccggatcataaattgacctttaatcgagtgaattcggtcatagagcaatcttccgtatttaccgtatttcaatggattgatacgttgttagagggaaaattagagcgggcagtgcgaattttacaagggttaaaagcagaagatgtacaaccgataattttgttacgtgctttacaacgagagctactcacgattttacaattgacccaaccacaacagcatatcgctaatattgacattccgctggtgaattcacaattaaaagaacggtttgatcgcttaaaagtatggcaaaatcgacgtcctttttttatccaagcgatacaacgtatgacttaccgaaagttgtatatgataattcagcaacttgctgatttagaaagaaaaaccaaggcggattttagtcatgatatttggaatgaattagataatttatctgcaaaaatttgctgtttttagttgaattcacaaagaatttaggtttattccatatctctactaacgatttttcttggattcatcattttttgtacaaaatatccgttataattcgtcaattaaaaaagttaatacataggaagaaaaatgatacgttttgaaaatgtgagtaaagcctatttgggcggtaatcctgctttgcaaggactcaattttcatttacctatagggagcatgacttacgttgtggggcattctggtgcagggaaaagtaccctattaaagttaattatgggcatggaacgagcaaatggcggtaaaatttggttcaatgggcataatattacacgtttatctaaatatgaaattccttttctacgccgtcaaattggcatggttcatcaggattatcgtttaatcacggagcataccattgctgaaaatgttgcacttcctttaattattagtggtattcatcctaaagaggctgaaactcgagcattggctgctttagatcgtgttggtttgcgtgagcgtgcgaaacattaccctgtttatttatcgggtggtgaacagcaacgagtggatattgctcgtgctattgtgcataaacctcaattattattagccgatgaaccgacgggaaatttagatatcaaattatcgttgggtatttttaatttatttgaagaacttaatcaattaggcatgacggtgttaattgctactcatgatttaacacttgtccagcagaaaccgaagccttgtttggttttggaaaatggttatttacgttaaggaaaggttatggctcatcgtcctatttatgcctcttggggcgtgcaggtacattatgtactgaaagcagtgttggcagggttaatcaagaaaaagtattcaactttaatgactattttagttattgcggtttcgttaaccattccaaccgttagctatttgttgtggaaaaatttatatcatgcaacgacaaaattttctcctaaaactgaattcacgctatttttgcataaaaatctatcggaaacagatgccaatattgttgtagagaaaatacgccagcaagagggcgtagaaagtttaaattatatttctcgaaaggaaagtttaaacgaatttcgtcatttttccggcttttctgaaggattggatattctggatgataacccgcttcctgctgttgtaatgattaaacttactcaagaatacaatgaaaatactaaacgccatcaactgcgtgaaaatctttttaagattaagggagtggatgatatacgtttagataatgaatggttagaaaaattgaccgcactttcttggctaatcgcacatattgcgatattttgtgccgtattgatggtatgttcagtatttttagtaattggaaatagtatccgatctgatgtatatagcagccaagcgaatattgaaattatgaaattactaggtgcaacagatcagtttattttacgtccttatctttacaccggcatgatttatgcaatattaggtgcgttatttgccagtatatttagtgccgcactcattggttattttacaagtgcggtcaactatgtcactgatatttttgcagtcagttttacgttgcaaggaattactatcattgagttattgtttttatttgtttgctgtacattaatgggctatttaagtgcttggctctcagcaagtcgttatatgaatttgttacataaaaatattagataaaaagcagaaaatttaaaattcttcgcttttttattaaaaaaacttgattttatcttaaatgttctgtaattaattgagatattctttttacaattcaacacaacattaactaataagggagattatatgaaaaatgtaggttttatcggttggcgtggtatggttggctctgtactcatggatcgcatggtacaagaaaatgactttacgaatattaatccagtattttttaccacttctcaggtaggacaaaaagcccctgtttttgcgggtaaagatgcaggtgaattaaaaaatgcgtttgatattgcagagttacaaaaactcgacattatcgttacttgtcaaggcggtgattataccaatgaagtttatccgaaattaaaagcaacaggttggaatggctattgggtcgatgcggcatcggctttacgcatgaaagatgatgcgattattgtgttagatcccgtgaaccaacatgtaattagtgaaggtttacaaaaagggattaaaacctttgttggtggaaattgtactgttagcttaatgttaatggcaattggtgggctatttgagcgtgatttagtggaatgggtttctgtagcaacttatcaagctgcttccggagcaggtgcaaagaatatgcacgagttattagtacaaatgggacagctggaagatagtgtcaaggacgaattggcaaatcctgccacatcaattcttgatattgaacgtaaagttaccgccaaaatgcgtgcagaggacttctcaacaaccaattttggtgctgcattagcaggcagcttaattccttggattgataaattattaccggaaacaggacaaactaaagaagaatggaaaggctatgcagaaaccaacaaaatcttaggactaagtaataatccaattccagttgacggtttatgtgtacgtatcggtgcattacgttgccacagtcaagctttcacgatcaaactgaaaaaagatttacctttagatgaaattgaacagattattgcaagtcacaatgaatgggtaaaagttatccctaatgataaagaagtaaccttgcgtgaattaacgccggcgaaagtaacaggcacattaagtattcctgtaggacgattacgcaaattagcaatgggacctgaatacttagcggcatttacagttggagatcaattattatggggggcagctgaaccggttcgccgtattttgaaacagctagtgctttaaatttaagagtgtagttaaatttattactcaagttggcactcgttattgtttgttatctgaattaaatacagtgataataaaataaataaagccctaattggggcttttttatattttaattattaatttgaacgcacttacatcaatgctttggtaggatttttttgctagaaataaaaaactattttttcatcaacaaatcacaactttttcttcatcagcattcgcatgttcgattttaccgattacccatgctttttcgcctacttgttgtaataatgccaatgcagtttccacatcttcctgtgggagagcgataatcatgcctacgccacagttaaaggttctatacatttcatagcgatcaatatttccttgttcttgtaaccatttgaaaataggatgccattcccaactcttttcattaattaccgctttaacggaagacggtaaaacacgcggaatattttcccaaaaaccgccgcctgttaaatggcaaatagcatgaacgtcagtatgtttaattaattgcaacaccggttttacataaatttttgtcggtgcaaggacttgttcagcgaatgaatgctcggctaattgtgctgttgtcggattaatacctgaaacttcaatgactttgcgaattaatgaatatccatttgaatgaggaccgcttgaagctaaggcaagtaatacatcgcctgctttaacgttggaaccgtcaataatttccgatttctcaactacacccacacaaaaacctgccaaatcataatcaccggtatgatacattcccggcatttctgcggtttcaccccctactaaagcacaaccggcttgcacacaaccatcagcaatacctttgatgacatctgctgcaacgtctacatccaatttacctgttgcataatagtcgagaaaaaataacggttctgcaccttgcaccacaagatcattgacacacattgcgaccaaatcaacaccaattgtgtcatgtttttttaggtcaatcgcaaggcgtaacttagtcccaacaccatcagttccggatacaagaataggatccttatatttacttggcaatgcacatagtgcaccgaagccccctaacccaccaataacctcgggtctagttgtacgttttacatcagatttaatacgttctactagtgtattccccgcattaatatccacacctgcgtctttataacttaatgattgtttactcacaattgaatcctaaaattagtatcgttattaaaataagcgatattgtaacacgctcaggcaatcgttttcgatgaattttgtaaagaaattttatcttttattcagcaaaagcgtgttgaaaaataaccgcacttttcctcgtctaaaaacgcagaaatgattatctaacgaattttcctgaaaatgatttaatccattagaaaatcatgcaaaatctctgcggtaaattctttccgcaaataaaatcctaaaggcaaagtatcgattatttcgccatttttaccgattcctttggttaacgctcgactatttgcccctttgggacggagttgcaggacctcaccaatacgggctgtaatttctgtgagcttacccagcacaatataatccatcaattcttcccaatcttgacgcagacgttgttcttgagaacttgatggctgccacaaaattggtacaccgacatggcgttcagcaagcggaatttgacgttcaccctcaataggaatccaaagcactttggataatttatatctgacatgagaagagtgccacgttacaccgctattttgggctaaaggtgccaaacttacaaaagtggtttccagaggataaccttgttgattaacaggaattgtttttagctcaatacctaaatggctaaaatcttgttccgctttgcttccggcagttgcacccagtgcggtttcaataagcattccgacccagcctttatctcgcttcaaatcgggaggcacaaccaaatttaactcttctgctaattcagcaaaggttaaacctgcaatagattttgcacgttgtaacagttcagcttcgtgttgagggggagtaagtgcggtcatgattgatgatatttttgtaataactttggtttcacgtattcaatgcctcgatcaatataatcaattttttccaattgcaataaatagcgttttgccggcaagcctccgccaaaaccagtaagttgcttttgttttcctaaaatacgatggcaaggaataataatgctaatcggattacgtcctacggcaccgcccactgctcttacggctttcggatgatcaatgaaacgtgccaattctccgtaactggcggaatgcccatatggaatttggcgtaaagcctgccatattttttgttgaaattccgtgccttgcggatgtaaaggaagatcggaaaaatcttccgcttccccgttaaaataacgatctaatgccgatgttacctgcaaaaagagcggtagattttgattaaaaatccaacgggaatttggctcaatttgttctaattcaaaatcaagatttgtcagctgattattttgcgacaacatcagcaatcgtccaattggcgaatgataataacaataaaaagtaggttgcataaaagaaaaaaggcgtattaacaaaatacgcctgattataacgaatagccgttagaaacggtagctaagatttaaaccgtacaaattggcacgtgctgttgattnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctttaaattgctgttttttaccacgtaaatgagcaaaacctacatcaacagaaagattaggcgtaaagttataggttgcacccaagctataccaagtgcggtcggtatcggggattgaagcactcggatggtcggcagactcatcataagcaatacctgcacgcagggttaatttatcattcacattataagtcgcccctagagctacacgtgaactgtcatgaaatttttcatctttatggaaagcgaccttaccgttatcataagtggcatgtaaactttgtaaacggctccatttagtatatttatagctgtagtgcatggcgaatttttccgttaattggtggaaaccggaaatttcgaaataatccggcaaatgtagcgttaannnnnnnnnnnnnnnnnnnnnnnnnnnnnnnnnnnnnnnnncaagtatataacccaatgtatcattatctttaaaatcaatatctactttagaatggtaggcaataccgatacgattatcttgattaaattcataaaccgcaccgatattccaacccaatccccatgcattgttatcttgtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaataccggcacgacgctcaattttcgctttggcataaaccgcatttaaccccgcaccaacgcttaatcctttgctgacacgatatgaaccgcttaaatttaaattaatggaattcagctcagtagtcccgccaaaaacaccggcatcataatcctttttatatttgctttgtaatccaaagttgacattcatacccgcaccgatagcaaatttgtcattaataggtgcaacaaaatacaaattgggaactaatgcaccgggaacaannnnnnnnnnnnnnnnnnnnnnnnnnnnnnnnnnnnnnnnnnnnnnnnnnnnnnnnnnnnnnnnnnnnnnnnnnnnnnnnnnnnnaccatttatattaattctagattgaacgtatacccccccccattgagaattgtttcgttttaaacaaactcattaacgctgggttggttgccacaacagcggcattatcagcaatcgctgcctcacccgcataagctcgtcctaaaccggaactggacacctcggcgagttggaaagctgccgcattggcataagttgtggataatgctagtgctgacgcaataagcgttggcgtaaaaaagttttttgtgaatttcatttttttcataagcaatatagataatcttagttgttaaaagtccatcgaattctaaaacatggttatgacatgagcaaataagtttacgccattaggtaagaggtcagatcagttaaatagggtttatcttttttaacctgttacattttatgacaaaaagagcggtccaaattggcttggaagttggagcaaaattaaaatgatgttaaaatttcaccaattttttaattttaaatcaaggaaataacgatgtcagaaaatgtattgaaatgtactccggaggaaactaaggcttgttgttgtgcagatgtgggaacgattatagataattcggaactcagcgtagacttttctcaagtctatgaaaatgaaacaacagctcaagaggcattggcatatttaacggaaaaagccagaaaagcggaaacggaatcttgtgacattcgtagcgagattaaggaagtaaacggcaattatcagcttaatgcaacgtttacttttagctgtcaagcagaaacgctgatttttcaattatctataagatgattgaacaaatgaggaatcgaaaaaggatcatgttgcccgtagcacgagttaaggcaatatgtaacgatcaagaattgtaacttgttgagaacgtgttcagaataggaaaatgttcaaataatgaacaccccatattacgtcgaggaaaataaatgttttatattagaaaagccaatgaacgtggtcatgccaatcatggttggctagacagttaccatactttttcattcgccggctactatgatcctacatttatgggattttcatcattgcgggtcattaatgaagatcgagtcaaagcagggttcggttttggtacacacccacataaaaatatggaaattctttcttatgttttggagggaacgattgcacatcaagatagtatgggaaatgtgcaaacaatttcagcaggtgaatgtcaaattatgtctgcgggtacgggcataacgcattcagaatttaatccaagcagtacagaaaatttacatttttatcaaatttggattcagccgaatgagttaaatattgctccacgttatgaacaaaaagcgtttgctcatcacgaaggtgcaactttgattttgtcacctcatgcggaaaatggggcattcaaaatttatcaagatatgaaattatggcgttatcaattaagagcaggcactcaaactgatattacgttggatagtaaccgctcttattggatacaagttgttaaaggcactttctttatcaatggtcaaacagtttcaacaagtgatggtgtggcaattaaccaagaacgtttagcgaagattgagacggaaaatgatattgagtttttgatatttgatttggcttaaaaatttttgggattcaatgttgagcaaattcaatgttcaagcaaaataaaaatgcctgtctttgatatatttcaaaagcaggcatttccacaatgttcgagtaatgcttaaaaactcaccgcacttttcagttttttcaacgcatttgtttcaagctgacgtacacgttcagcagaaatgttatattttgctgcaagatcatgtagtgttgctttttcatcatctaaccagcgtgatttaataatatctcgactacgttcatccagttcagctaaggcgttggcaacctgatctgctgcttgtgtctcaaaattttcgttttctagctcagccgcaaaatttgagcttttatcttctaaatagagtgctggtgcgtaactttcatcatcatcaacgggtaaatcaaaaccgacgtcagatcctgtcattcgactttccatctcaaggacatcttctttggaaacgcccaattcatttgcaaccatatcaacttctttatcactgaaccaacctaagcgttgtttagttttacgtagattaaagaataatttacgttgtgctttagttgttgcgactttaacaatacgccaattacgtaatacatattcatggatttcagccttaatccaatgtactgcaaaagaaaccagacgaacaccaacttcaggattaaaacgtttcaccgctttcatcaagccgatattaccctcttgaataagatcggcttgcggtaaaccataaccggaatatccacgtgcgacatgaataacaaaacgtaaatgggacaaaatcaatgtttttgccgcatctaaatcttggtgatagtacaaacgttccgccaattccttttcttcttctgcagtcaacattgggtaatcataggctgcgtggatataaccttcgatactaccttgcggaactaacatcattgcttgtgtttctttattcattctattcctttttgtttataaaagacttattttctctatactttaagacttttaattgttttaatcaattaatatcttaaattctaatagttagaccataaatacattaaaaagttttcgtgttattttaaaattggcacaagaacatattctacattttgttcaattacttgcaataataaatcaatatttgggtgcttccccggattttctttagcatctaaaacatgttcggcaaatagttgcacgcctttttccgcacaagtgcggtctaatttaccgttaaatttttgagccaacgcattataaacacgcaaagaacctaattttccctgctcggcaggaatatgatgcacgacttgatcgtttgctaatatatctaaaccggacaagtgttcaatactgggtaagctcgttaaaattgtttggaaatccattttatttctccattattatgaaatataagcagtactatccacttcaccgttttccccaataaagcgtacttccggtcgtaaatagacgttaaattttagtattaccgtttggtgaatatgctgtgctaatttaaccacatccgcactacttgcattatctttattaataatgacgagtgcttgttgctgatgaacagcggcaccgccgatttgatagcctttaagtccagcttggtcaattaaccaacctgctgctaacttaattgtgccgtccggctgtggaaaaaaaggtatagttgggtaatcttgttgtaaaagcgaaaatgcttgtgctgaaataatcggatttttaaaaaaactaccgctattaccaaactcatcgggattgggtaatttgctttggcgaatatgacaaatttcagcaaaaatttcttgtgcgttgacttgatgtgtatcgaattcagttaatgtgccgtattttaataccggttgccaattttttgctaattttagaccaactgcggtaataaaatacccttctctgtattgccttttaaaaatactttctcgataagcaaacgcacattcttcattgcttaaacgaaatattgtatttttttgtaaatccaatacgtccacataatcacaaacatctttaaattctacgccataagcaccgatattttgaatgggtgccgatcctgcacaacccggaatcaaagcgaggttttctaaaccataaatgccttgtgttaaggaccattgcactaaattatgccaattttctccgccattaacatgtaaataatgaaagtttgcatcttgcttatgttcaatccccataagctgattaataaatacaatgcctttaaaatcgtccacaaataaaacgttacttccttgtcccaaaaataagatcggcaaagcgttctttttcgctaatttccattgctcaattaactcggaaagtgcggtgatttttataattttttttgctttagacggaagatgaaatgtatgaaagtcttgtaaattttccattaatattccttaaaatgtattcggtaaagttaatttcacttcggtaccgcctgtcgaatgattttgaatagacaaacgtgcatttaattggttactgcgttctaacataatatttaatccataatgcccggttggttcctttaaacttggaataccaatgccattatcacgcacagccaattcatattcaccgtcatcattagtataagccagcacttcaatttctgtgccttgtgaatgtttaatcgcatttaatgtcgcctctcgcacaatttgtaacgcatgaactagttgttgggcgttaaatgtttgtgaaggcaaagaacaatccactcgcattcgcattgaggtttgattgcgtaatgaatctatcacttgttctaaagcaacctgtaaatttgcctcttgtatggttaagcggaatgtggcgagaagttcacgcaactgtagataaccggcggtaactgcttgctcaaaatcttgaataatttcttggcttttggctttggcatcttgagtttcttgttgtagggtatgttttaataaagtgagttgaattttcaaataagacaatacttgagccaaagaatcatgtaattctcttgcaataattgaccgctcttccatgagtaataaatgctgttgttgtcgttgcatttggtaaaaatacagcgtgcgactgagcatttgcgagacattgtgcattgtgcgtaaatccggacaaggtaagccggcttgccaacgcataatcccaagttgattattttcgatttctaaatccatactttgtaaatcaacggggtcttgttttgttcctaaagaaatatgccaatgctctgcaccatgaacaattaattctaaataccgcaaatgttcattaatcatcacttgttttagcatttgttgaaatagtttaggttcaatggcttttgtagtaacaagttgagaacaatgataaagcatggttaaagagcggttagcttgacttaacttttgtgttttctcattcactttttcctccaacgtggcataaagtttttttaactcggctgccatttgggtaaaaactaaagctaatcgaccaatttcatcatcacttttggtgtctaacggaatatggttaaattgtccaatttgaacttgagaacttgccaacgctaatttttccaatggggtaacaactcttttgcgtgtaaaataaatgacataggataccatagctaaaatcacaatcattgctactaaaatactgagtacggcgattttaagtttcagctccgcaaaatactgtaaagtatttacaaattgatctacttgatcgacatagctggcgatttctgcacggtaagcatccttgttgttttcttttgcatgcttttccatgatctcccaacgcttgattaaattacgataggattgccttacatcattaggtacaagaaaatgccgactaattttgagtaatggctctgaatgcaaacttaaacgatattgacgcaatgccctctctacattgtccggttcatattccatttcataaaaaagtcggtaactttgcatacgtaatgagccggaaacattgattaactctgcatcagatttattactttgcataatagctaaactcattatgctaattaacgatacaaaaataatgatgagcaataaatagttggcaattttagttgaaacagaatgattttttatattcatataaacgtttttaagcaaaaatctcaccctatcatacaacagaatgtattgaataccgcatactttattattcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaacggcagacgaattggacagcctaaaccgtttggtaacaatttttcttgaaagtgccgaattgcgtgtcaaaaatcgccaagatttaaccttgtcattttggcggaacaatgtggataatttacttgaatttaacggatttgccattttggacaatcaaggcagtcgcaccaacgcccaagcccaaaccatagctcacgagcgatacgagcaatttcacgctaagcgacaagcccaaaaacttatcaatgcagacagtcaggactggcaagaattgcaaaccctagaaattgaacttaaaaaagcgaaataacccaacgatgagcaagcatacaatgaccgcaaacaacacattaccgcaagggtggaagaaatataatttatttgaaatttgtaaacccaaacaatggaaaactattgcagtaaaagatttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataaatttgatctacctcaacaaacttacattttgtcgagcaaatactcatttttggttattaaaaatcagcggtaaggtttggacaataaaaatctataaaagaatagtgtggtttttaggcataacgttggtggaagaacagttatccagcaacgataacaacctcaaaataagaaagaatatgaaagaaaataagaacgcaaaaaatcatgctgaggagtggcatgtttgtggcttaattattcaagtaaacccacaaaaaatagcacaagttaagaccgctcttttgactattccgcatacggaaattccagcagaggatgaaaaaggaaaattggttgtggttatgcaatcggacgatccgcaggttttactgaatcatatggaaaattcacgcaatattgatggcgtgattgatttgtcgctgatttatcatcaacaagatgacaatgttgagcaataatttaaaaacgaatagtgggggagactatgaatttaagtcgtcgtgattttatgaaagcaaatgctgctttagctgccgcttcagtggctggcttaattattccggtaaaaaatgtaaatgcagctgacacaagtattacttgggataaagccgtatgtcgcttttgcggtacaggatgtgcggtattagtggggacaaaagatggacgtgttgttgcttcgcaaggtgatcctgatgcagaagttaatcgagggttaaactgtattaaaggttatttcctacccaaaattatgtatgggaaagaccgtttaacgcaccctatgctacgtatgaaaaacggtcaatatgacaaagaaggggaatttacccccgtaacttgggattttgcctttaaaacaatggcggaaaaatttaagtctgcattaaaagcaaaaggaccgaacggtgtaggtatgttcacctccggacaatccactatttttgaaggtgtggcaaaatcgaaattattcaaagcaggattactttcaaataatattgatccgaatgctcgtcactgcatggcatcggcagctgttgcctttgtacgtacctttggtatagatgagcccatgggctgttatgatgatattgagcatgccgatgctttcgtgctttgggggtcaaatatggcggaaatgcacccgattttatggtctcgtatctcggatcgccgtttggctaatcctgatacggttagtgtaaatgtcctttctacctttgagcaccgctcttttgaacttgccgatttaggtattcttctcaaacctcagtctgatttggctattttgaactatattgcaaattatctcattgaaaataatgcaattaatcgagagttcatcgaaaaacataccaaatttaaacgtggcgaaactgatattggttatggcttacgtccacaagatcctcgtgagcaaatagcgaaaaatgttaaaactgcgggcaagatgtatgatagttcttttgaggaattcaaaaaattagttgcaccgtacaccttagaaaaagcacatgaaatttccggagtaccgaaggagcaattagaaaaactggcaaaactttatgccgatccaaataaaaaagttgtttcttattggacaatgggcataaaccaacacacacgtggtgtatgggcaaaccatttaatttataacattcatttattaaccggaaaaatttcattaccggggtgtggtcctttctcattaacaggtcaaccctctgcttgtggtactgcacgtgaggtgggtacttttattcatcggttaccggcggatttagtagttactaaaccggaacatcgtaaaattgcagaaaaaatttggaaactaccggaaggtttgatttcagataaattaggcttccacgctgttgcacaaagtcgtgcattaaaagacggcaaaatgcaggtgttatggcaaatgtgtaacaacaatatgcaggcaggtccaaatatcaatgaggaaacttacccagggtggcgtaatccggataactttattgtcgtttcagatccctatccaactgtatccgcactttcagccgacttgatcttaccaacagcaatgtgggttgaaaaagaaggggcttatggaaatgcggaacgtcgcactcaattttggcgtcaacaagtgaaagcaccgggtgaagcaaaatctgatttatggcaattagttgaattttctaaatattttacgactaatgaagtatggccagcagaaattttagcgaaaaatccggcataccaaggtaaaacactttatgaggtgctttatctcaatggacaagtaaatcaatactcaaatgatgaactgaaaggtcgcctaaatgatgaggcttaccattttggtttctatatacaaaaagggttatttgaagaatacgcacgttttggtcgaggacatggtcatgatttagctgattttgacacttaccataaagctcgagggttgcgttggcctgtagttgacggtaaagaaactttatggcgttatcgtgaaggttatgatccttatgtaaaagcaggggagggtgtttctttttatggtcaggcggataaaagagcggtgattttagcggtaccatatgaaccgccggcagaggtgccggatagagaatatgatttatggctgaccacaggtcgcattcttgagcattggcatacaggctccatgacacgtcgtgtaccagaattacaccgttctttcccgaataaccttgtttggatgaatccgaatgatgcgaaaaaacgtggtttgaaacatggggataagattaaggttatttctcgccgaggtgaaataacgtcttatatagatactcgtggacgtaataaatgtcctgaaggtttgatttatacgactttctttgatgccggacagctggcaaataaactgatattagatgcaacagatccgatttcgaaagaaactgacttcaaaaaatgtgcagtaaaagtggtgaaagcgtaacaatcaacaaaaggcaccgcactttacttgctaaagtgcgatgaatattcatgaagaaaattgcttttacaccggaacgccgaaaatttttaagagataccgcccgaacctgtggcggacttgccggattaggcgtattacttggcttacaacaacatcaaagtctggctagacagggtgtggcattacgtccgcccggtgctttggctaatgaccaagattttacagcggcttgtattcgttgcggtcaatgtgtacaggcttgtccttataaaatgctgcatttagcctcattattatcttccatagaggctggaactccctattttattgcgagagagaaggcttgtgaaatgtgtgaggatattccttgtgttaaggcttgtccgagcggtgcattggataatcaacttgatgatattagtaaagcaacaatgggattagccgttttgcttgatcacgaaacctgtttaaactggcagggtttacgttgtgatgtttgttatcgtgtttgccctttaattgataaagcgattacgttggaaactcatcgcaatgagagaacaggaaagcatgcagtttttatccctactgttcattctgatgcctgtacaggttgtggtaaatgtgaagaggcttgtgtattggaagaagtcgctatcaaggttcttcctaatacattagcaaaaggtatgttgggagaacattatcgtttgggctggcaagagaaagataaagtagggcattctcttgcacccaaagacttaatatccttaccaattcgtcaaccggagagtaaataatggcaaattctcctaaacacagcggtaaagaatcaagagaaaaattaggtttttggcgtgcaaaccggttcctcattttacgtcgggtaactcaattcagcattctcaccatgttcttgagcggaccttatttaaacttttggattctaaagggtaattatagtggtagtttattattcgacactatcccattaaccgatccgcttattgtcgccgaaagccttgcaacaggctatttaccgaacagttcaacgattattggaacaattattgttgtatcaatatatgctttacttggtagcaaagttttttgtggctgggtttgtcctcttaatgttgtaacggattgtgccgcttggttacgtcgaaaattaggtattcgtcaaagtgccaaacttcctcgtggcttgcgttatggtattttgctgatgattttaatggggagtgcagtaagtggcgtattgttatgggaatggataaatcctgtttccgctttgggacgtgcgttaatttacggggttggtgcaacaacttggttgatatcggcagttttcttatttgacttatttattgtggaacatggctggtgcggtcatctttgtcctattggtgcaatttatggtgtgattggggcaaaaagtttattgcgtattaaagtagttgagcaacaaaaatgtgatcactgtatggattgttaccatatttgtccggagccgcaagttttacgtgcaccgctacacggtaaaaataatgaaagtcggtttgtactttcaaaagattgtatcagttgcggacgttgtattgatgtctgtgctgaaaaagtatttatatttagcaatagatttaatcattctgggagtgatcaaaaatgatgaaaaaaacactattatttattaccgcactttttgtgtcttctgcttttgcaacgcagaaagtgggaaaaaactaccaagatgctgttgaaaatgtgccagctgcatttcataaccatataaaagaaagtacaacgcccgcattaaactatgtaaatcaaccacctatgatcccgcatagcgttgcaaattatcaagtaacaaaaaatacaaaccagtgtttaaattgccatagtccggaaaactcgagaattaccggagcaacaagaattagtccaacgcattttacagatcgtgacggcaatgttaccggtcaaactgcaccacgacgctatttctgtttacattgccacgtatcgcaagcagatgttgctcctattgtgccaaatgaatttaagccaatgaaaggctatggtaactagatgaggatagatgtatggcaaatgaaaaatcaaatatcatcgttcgtttaagtaaaagcggttggaaatggtttaagaagccaagtcgtgctatcagtgtattgattttattatcatttattgcaggtattattttttggggcggatttaacaccgcacttgaatacacgaatacggaagaattttgttccagttgccatatgaatgatgttgtacctgaatatcgtcattctgttcactatatgaatcgcagtggagtaaaagccgactgtgccgactgccatttaccgcacgaatttattccgaaatggacacgtaaaatcggggcggcaaaagaagtttatgcgtatattacaggcaaggtagataccaaagagaaatttgaggcacatcgcttagaaatggcacaacgtgaatgggctagaatgaaagccaatgactcacaagaatgtcgtcattgccataatttcaatgatatggatactactcagcaaaaaaatgtcgcacaaaaaatgcacagaatagcacaagaacaaggcaaaacctgtattgattgtcataaaggtattgctcaccaattaccgaatatgaaagacgtgcaatccggttttttacctgagcaatagtgaaaaaattgaccgcacgttgagttgcacctcaaacgttggataaatccgactgattgaggtgcaacattgtgactatttgattttaaattatttatcctaatgcaactctcgcattttggaataaacgcatccaagccccgtcttcttgccaattttcaggataccaagaattgtttactgctctaaatacacgctcagggtgtggcatcataatagcgactcgtccgttggaattagaaagtgcggtaattccctccgcagatccgttcggatttgccggatatatttctgtcggatttaactgactgtcgatatattgtgcagcaatcaaattctgtgcttttaatgcttgcaactgctgatcatgcttaaattcaattcgtccttcaccatgagaaaccgcaatcggcatatgtgatcccgacattccgttaaaccatacggaatgagtatcgttaatgcgaaccattgcaacacgagcttcaaaacgttctgatttatttcgtacaaatcgtccccagttttccgtaccgggtataatttctgctaaattggataacatttgacaaccgttacaaacacctaaggctaatgtgtcctgacgatggaaaaatgcactgaattgatcacgaagtgcagtgttaaacagaatagatttagcccaaccgccaccggctcccaagacatcgccataagaaaatccaccgcaagcaacgagtgcgttgaaatcctgaagatgatgacgtcctttttgcaaatcactcatatgaacatcaatggcattaaatccagcacgatcaaaagctgccgccatttcataatggctgtttaccccttgttcacgtaaaatagcaatacgaggttttgttcctttttggatataaggtgcggtgattttttcatttagatcataggtcaaataagcggaaagtcctttatcattcggatcttttttcatctcaaattcttgatcggcacaatctggattatcacgtaaacgttgcatttgatgtgttaattcagcccaaatcccacgtaatacggagcgtttttcactcaataagactctggtactgcgagtaatctcgatatgatcatctgcggtaacaataccgagttctttggttaaatgaattaatccatgttcggtcaatacggcacgcaccgctttaaggtcactttctttgacttgaattacggcacctaattcttcattgaataaaacaccgagatcattgtcacccaatgcactgatgtctatggaaataccgcaatgaccggcaaaagccatttccgcaagcgtaacaatcaaaccaccgtccgaacgatcatgataggccagcaatttctcttgtttcacgagagcttgcattgcattaaaaaagcctttcagcaaagacacatttactacatctgccggtacatcgcctaattgcttatacacttgagcaagtgcggttgcacctaaacgattttttccctcacctaaatcaattaatagtaatcggctatctcctttgtccatacgtaattgaggtgtaaccgtcttacgcacatcttctacacgagcaaacgcactgataattacggaaagcggtgcggttacggatttttgatatccttcttcctgccaagtggttttcatagacatggaatcttttccaaccggaatggttaaacctaattgagggcataattcctcaccgattgcttttacagcctcataaagtccggcatcttcgccgccatgacctgcggcagccatccagttagcggataatttaatccgtctaatatcgccgatatccgttgcggcaatattggtaatgctttctgcgacagctaaacgtgcagaggcggcaaaatccaacaaggcaacaggagttcgttctccgatagacattgcttcaccgtgataactgtctaaacttgctgttgttaccgcacaatccgccacaggtacttgccacggaccgaccatttgatcccgtgctaccatacctgttactgagcggtcgccgatagtgattaaaaatgttttctctgctacggcaggtaaccgcaataccctgaacaatgcttctttaatttggatcatagactgatccaattggggattattgacttttgcggatttcacatcacgtatcattttaggggttttacctaacaagatgttcattggtaaatcaataggattgttattaaaatggctatcttgcaaagttaactgctgttgttccgttgcctcaccaatcaccgcaaaagatgctcgctcacgctgacaaatcgcttcaaagagcggtaatttttctggtgaaacggctaaaacataacgttcttgtgattcattgcaccaaatttctagcggcgacattcctttttcatcgcataaaatttctcgcaacgcaaatcgcccacctcgaccaccgtcatgaactaattcaggcatcgcattagataacccgccggcaccgacatcatgaataaaaagaatggggttttctgaacctaattgccaacaacggtctattacttcctgacagcgacgctccatttccggattatcccgttgtacagaagcaaaatccaaatcttcttttgactttcctgatgccatagacgaggctgcaccaccgcccagaccaatattcattgctgctccgcctaacacaattaatttcgcaccaacaggaatttcgcctttttgcacatgttcatgacgaatattacctatcccgcccgccagcataatcggcttatgatagccccgcacttcttcgccgttaaaactgttgactttttcttcataagtacggaaataacccaataaagcaggacgcccgaattcattattgaaagcagcaccgccaagcggaccttcaatcataatatccagtgcggaggcaatacggctcggtttactcaacgcattttcccaaggttgcggaaaattcggaatacaaagattagacacggagaaaccgactaaaccggctttcggttttgcaccacgtcccgtggctccctcatcacgaatttcgccacctgaaccagttgcagctccggggaaaggtgaaatggcggtagggtgattatgggtttccactttcatcaaaatatgcgtgtcttcttgatgataacgatattgcccgtcttggtcagggaaaaagcgtccgacttttgaaccttccatcaccgcagcattatctttataagctgacaatacataatcaggcgttttctcaaaggtgtttttaatcattttaaacagcgatttatcctgtttttttccatcaataatccaatctgcattaaaaatcttatgacgacaatgttctgagttcgcttgtgcaaacatataaagttcaacatctgtaggattgcgaccgagtgcggtgaaattttccactaaataatcaatttcatcttttgctaatgccaatcctaaagtcacattcgccttttccaatgcaacatgcccaccggttaaaatatctaccgtggtgaaaggttttgggtcatgctgttcaaataaaacagctgcttcttgtggagaacggacaatactttccatcatagggtcgtagatacggaatactaattgttgttgttcttcagccgttaaagtgcggttaaatttgaaataataagcgataccacgttccaaacgaagtaccttatttaaatcacaattatgtgcaatatcagttgcttttgatgcccaagaagaaatcgtacctatacgtggaatcaccacaaaacattccccataaggctcttgcgatttctgagtcggaccataacgcaaaagctcctctaatttttctctttctacctcagttaatgcttcacttaaatgggcaaaatgcaaaaattctgcataacaagacacaatgggtaaattatcttgctgaaaaccactgaataactgatttaaacgaaaattggataatgcgggcgtaccacgaaaaatgtgtaacatagaaaagatccatcaaaaaaataaaaaacgaccacattataaaggaatttttatcggaacgaaaacgtttgcctaatgcaattttcaaaaaatagttaataaaaagctgataactgaaatgatctgcactccaaaagttggattaaacaactaactgatgaagtgcagatttttttaggattaattttttggtaaatatctcattggatctactgattgacctttataacgaatttcaaaatggagtttgattgtgtttgttccagaacttcccattttagcaatttgttgacccgctttaacttcttgctgatctttgacgagtatactttcattatgtgcataagcacttaaataactgtcattatgtttaataataattaaattaccatatccacgtaaagcgtctccggcatatacaactcgtccagcagcagctgcattaacagcttgtccacgagaaccgctaatatcaatacctttattgcctccatcagcactggaaaatccttgaataatttttccatttgttggccaaatccaagctatatttgaggtggctggaggtgttttattgattggcattgttgaatgtgttggtgtagcaacggatttcatttgttcatttgttggtttattagcattccatgtctcattgactgtattttgtgtcacctctgattcatttattgtctgtgttggtatcatattgctatcgggaatattatttgcaattttcaatatttgtccaatactcagatgatatggttcagacatattatttagtgtggccaattcttttatatccatgcctgaaatataagcaataagaaacatggtatcgcctttgcgtactttgtaagtatcacctttgtaaaaacccttatcaattttgctataaacaggcacattagttttaggatctcttggaatttcaaaattttgtagagcctgtttttttgctatcgattctgttttttgttgattttgttgaatgatttcaggttgataagtggaatttgttgctttcggcactctcatactttcgggcatcttttgttgaataacttgaggttcccaagcggttgagtttgtaccattaatcggtttgataatacttggtgctaaatccttagcattttctaccggagccggagtgtgtgaactacaagcagctagtacagtgatactaatagataaaggtaaaaattttttcatgtaaattctccgttactttatattcattttttatcttagattatttcaagacaagatatacaactatagcaataatgacaactgaccaaccgataaattcaatagattgacgtaatttcgcagcaaatttttttccgctccaagccgctaaatgggtaacgagcaaaaatcttgcaatacgagaaataaaggcagtaagtaagaaaggcaaaaatgccatttgcatgacgcctgcacaaatcgtaaaaattttataaggaataggtgaaaaacctgcaacgaaaactacccaaataccccattctttgaaccaagaaagagcagtttcccaatgttgttgataaccccattgttgaatataactttgtatgaaatcaaaagcgtaataacctaatccataaccaattgccccaccaatggctgaagccattgctgcataaaatgcaaatttagtagcacatttaggtttatttattgacatcggaataagcatgacatcaggtggtattgggaagaaaatagcctcaataaaactaacaaaagttagccaaaatgtagcaaaacggtgatttgcccattgcatagttttatcatatagcgtaccgaaaattttcatgttttattccttcgatgaaaagattatcgttattccttatctaaccattgttgtaaagctgtcattgaatgatatgccgtcatatctgtttgaatgggtgtaattgacacatagccgtttttaacggcatggaagtccgttccttccgattcattttctgccagtcctattggtccaatccaataaatctcttcacctcttggatctttttgtttaataatatccgctgcagctgcacgatacccaagatgacaaactttaataccttttatttctgaataggggagatccggcacattaatattaataatttctcggctttttaataatcgtccatatagtttaggaataagttgactcacaattattgccgcactttcataatgttgtcgtccatctaaagaaactgcgattgcaggtaagcttaaatggcgaccttccagtgcagctgcaacagttcccgaataaataacgtcatcacctaaattgactcctgcattaatacctgaaacgacaaggtcgatctgaccggataaaaaaccgttgagtgctaaatgtacacaatctgcgggagtgccattgatactataatcaccattatccaatttcattggtcgtaaaggctcaacgagtgtgagtgagcttgaagcagcactacgattacggtctggtgcaacaacagtgacttgtgcaaatttacgtaattctttagcaagagttttgattccctctgcctgtatgccatcatcattagaaagcagaatatgcatattgtttcctatgttttaaattattattcattaatattaaccagttctcttacgagggctgtcgcataacttcctgctggtaaataaaaagtcagttttaatccctcaggtataaatgaccagcttaagtgttgagcttgcataagtattggacgacgtgccgatttcattttttcctggtgcattaagtacaggagttcttgatgtttagcgataatttcattttctacatcactggcaatttgtacattttcaccaattaatggtgcagtgatttgaatatcctgttgtgctaaacgttgttgtaataaattaaaatcttctttttgatcagcatggaaccaactgtgtgagccggataactgcaaaatatcatttactaagattttatggtgtagaccttgtcgaatacgagcggatacaatcaagttaaaaatttcactacgagcagcggagagataaaaactacgctttttgcgatctttaacgttaatttcacctttagcccagcgtaaagcctgagttaaattgtgtccatctcgtccgaaacgttgctcggtaaaataatttgggaacccatttttcttgatattttctaaccgcactttgagatctgcatcttcttgtgcttcacgcagtaaaatttcaaaatggtttccgtccaagcttcctgtgcgaatttttcgattgtgacgtgttacctcaaggatttccacaccatcaagttgaaattgattaaagtcaggtgtgggttgtcccggcatctgtaaacaaaaccattgttctgtaatcgctttacgatctttgagtcctgcatatcccatatttttagcaggtataccagcaaagtgtgccaatttttctgcgacaaatagagtattacaatctgttttacgcactttaacagcaacaaattcgccatcaccggacatttcatagcccagttgttctttcacaacaaaatcagcacagtgtgtttttaaaagtgcggtctgttttggcattgtttgtaaataagcgagttcgttcattactttgtgccattttgttttattaataggacaacagcttcacaagcaatgccttcactgcgtccagtgaagcctaatttttctgttgtagttgcttttacattaacctgttcaatatcacaatgtaagtcctgtgcaatcacagtacgcattgagtcaatatatggacgcatcttgggagcctgtgcaatgatagttatatcaacattaccgacttgatagcctttgtctaaaattgcttggtaggctgttcttaataacctgcgactatcagcacctttatattgtatatcagtatctgggaataattttcctatatctcctaaagccattgcacccagtaaagcatctgttaatgcgtgtaatgccacgtcgccatcactatgtgcaactaaacctttttcataagggatagcgacacctccgatgataataggaccttcaccaccaaaggcatgtacatcaaagccatgaccaattcttatcatattttttcctaattaatgctcttttttcataatttgttggatttcagccatcatttcttggtcgacgtctaaggctatttgaattaattctttattttcaaagcgagagagttttggatcataaacctctgccattagcttcacgctatgacgatcttttctaaagtaggcttcaccaatttctgtcactgtatcttcattcatacctaaagaaagtaaagcttctttacctgttcttaatgctgaatcaaaagtttcacgaatttgaatattggcacctgcaccatacagattgtaaacatgaatacggtcatgagcacgtgcaataattttaatttgtgggttcattttacgagcttgctcaacaatttgtagagtttgttctctgttatcaattgctataatcaataattcggcattttcgacacctgcagcatgtaatagctcaggacgagcagcatctccatagtagcatttaatgcctaattttttcataccggcaattaggtttgcgtctttatcaataatagttgggtgatgccccgtcatcactaacattctatttacaacttgtccaaaacgtcctagaccaattagtatagttggatgttgttcatcaatatgatccgcttttctttccggttgagtcggtttgagacgaggaattatgtatttcttttgagcaataataaagagcggtgttaaaatcattgaaagtacaacaatagctgtcatattcgcttgcatttcttcactaataacattttggctggcagccgcagagaataatacaaaggcgaattccccaccctgtgccataataaatgctcggtcaatagaattagcattaccggtttttgtgattaaagcgattaaataaattataaatcctttcactaacatgaaaactagtacaccaaaaataattaagaaccaattttcagcaacgacggaaaggtcgagtgacataccgacacctagaaagaacaagcctaatagcaaccctctgaaaggctcaatatcagcttcgagttgatgacgaaaactggattctgaaagtagcactccggctaaaaaagcacccatagccatagagaagcccccctcttccataagtaaagcagagcctagaacaacgagaagagcagctgcggtcattacttctcgagtcttggttttagccaacattttaaataatgggtttaagagccaaagtccggctgccactaaaacagcaaaagccgtgccggatattgcaattttatgccaaagcggatcagttgaagtaactttatccggcgataaaaaagccacaaaagcaagtaatggaacaatgagtaaatcttcaaagagtaaaatcgaaataatacgctgtcctcttggagaggtcagatcattacgctcactcagttcttgcattacaattgcagtagaagtcaatacaaaaccggaggcggcaacaaaagcaactttccaatcaaagccaaataaagtagcaatataagttaaagcactggtacaaagggtaatttgaaatgcacctaagagaaagatatagttacgtagtccccaaatatgagagggtttcatttcgagtccaatgatgaataaaaacatcaccacacctaattctgctatatggattattccctctggatctgtaaagagaccgaacccaaagggaccaataactaaaccggcggctaaatagcccaatactgaacctagtcctaagcgtttgaatagaggaaccgcaactacggccgccgctaaaagcgtaacaacgctaacaagtgggtttgccccttctgctaccataataattacctttgttttctagttaaaaaaaattctgccaatgccaagtcttcaggacgtgttactttaatattatcactatgtcctgctactaagtgcggtctaaatccggcaagttccatcgctaatgcttcatctgtgacgataatacctcgttttgctgcttgctctagagcgtgttgcaataagtgtacagggaaaaattgcggtgtttgtgccaaccataattgattacggtcttctgtacattgaatttgcaatactgaatttgatcgtttaatagtatctaccgcaggaatagctaaaatagcaccattttgatcttcaacttgtagtaatgtatctaaatcttcattgcgtaaacaaggacgtgctgcatcatgcacaagcacccaggcttttttatttttaatgtgacgtaggccgtttagcacagattccgcacgattctttccgccaataaccatattgatacgaggatttcgcaataactcaatatcaattaaataaggatcattttcagcgacagataaaacaatttggctaattttttcgcaactcaaaaaaatacttaatgtatgctctaaaattgttttgcccagtatctttaaatattgttttgggcgatctgcttgcatacggcaaccaatgccagcagcaggtattatagcaacaatttctctatccatttatctattcttattttttactatacgataaaaaacttcattttgcttgatcatttcatgttccattctagctctttcctcgattgcttctataccattcttcagatcctgaatttcagcaaaaatagtttgattacgttgtgacagctttttgttttcttgtttacgttggataatttctgctttgatatcttgataatcaagatagccattttttccaaaccaaaaatcatactgaaacataactaacaaagcgaaaagacttaaaataaataaacgcatttttatctcttatttttcataccaaattttatttatgtacaaagaaactatacctgagggagtggctactttgatttcgtcatcgacttctttgccaattaatgcccgtgctacagggctatcaatggagatccaattctttgcgggatcaaattcatcacagcctacaatgcgatattgtttttcctctccttgctcatcttctaaggcaacccatgcaccaaaaaagactttaccttcttgctttgggttatagtccacgatttgcaatacttccagacgtttcattagaaaacgaactcggcgatcaatttctcttaaacgacgcttgccgtaaatatattctgcattttcactacgatcacccaaggcggctgcatcggaaacagcttgcgtgattttaggtcgttcgtctttccataaatattttagctcttgatctagaatattccagccggaacgagtgatataattagatttaggcattgtatctttcctttcaaagagagcaaaattgtaacataagatcaataataaatatgtgaagaatagttaaaattacagttaattttacaattttttccaataattgtttgaactattacgttaaactcagtatgctaccgcgaattttttaaacagaatataatagaaatagagacaagatgttaaatcaacaaatcgccggtattattgcgaaagaactaactgttctgccaaatcaaattttatcggctatccaattattagatgatggcaatacaattcctttcattgctcgttatcgtaaagaaatgaccggtggattagatgatacccaattacgtcattttgaaacacgtttaatttatttacgtgagttagaagatcgtcgccaaacgattctcaactctattgaagaacaagggaaattgacagatgaattgcgtagtcaaattgaacaaacgcaaagtaaaactgaattagaagatctttatttaccgtataaaccgaaacgtcgcacaaaagggcaaatcgcaattgaggcaggaattgaacctttagctgatttgctttggaatgcacctgagaatgaaccggaaatcgttgcggcagattatatcaatgcggaacaagggtttgcggatataaaatctgtgcttgatggtgctcgttatattttaatggagcgttttgccgaagatgcacaattgttagcgaaaatccgccaatatttacagaaaagtgcggtactggtttccaatgttttagaaggcaaagaggctgagggagaaaagttccgagattattttgaacatcaggaattactccgcaatgttccttctcatcgtgctttagctatgttccgagggcgtaatgaaggctttttgcaattaaggttaaatgcggatcctgagcaagaagaaggtgttcgtcatagttattgtgaagaaattattcgagagcatttgggtattcatttaactcagcaaccagcggataagtggcgtgagcaggttatctcgtggacttggcggattaaaatctctttacatcttgaaactgaactgatgagcagtttacgtgagaaagctgaagatgaggcaattgatgtttttgcccaaaatctaacttcattattaatggcagcacctgccggagcgaaaaatactatggggctagatcccggtttaaggacaggtgtaaaagtcgctgttgttgataatacgggaaaattagtggcaacagagatagtttatccacataccggacaaatgaatacggcaatgtcagttatttatcaattaattaagcaacataatgttgagttaattgccattggtaacggcacagcttcaagagaaactgaacgatttgctaaagatgttattaagaaaattgagcaaaataaaccacaaacagttgtggtcagtgaagcaggtgcatctgtttattccgcatcagaattggcggcacaagagtttcctgaactggatgtgtctttgcgaggtgcagtttctattgctcgccgtttacaagatccactggcggagttagtgaaaattgaaccgaaagcaattggcgttgggcaatatcaacatgatgtaaaccaaactcagcttgctcgtaagctagatgcggtagtagaagattgtgtaaatgccgttggggttgatttaaatacggcatcagcacctttacttgctagagttgcaggtatgactaaacatcttgcacaaaatattgtggcatatcgtgatgaaaacgggcgttttgaaagccgtaatcagttaaaaaaagtaccgcgtttgggtcccaaagcctttgaacaatgtgctggttttatgcgtattgcacaaggtaaaaatccgcttgatgcctccggtgttcaccctgaggcttatcctgttgttgaaaagattttacaggctacggaaaaatctattcaagatttaatgggaaatgtgagtgctgttcgacaattagatgcaaaacaatttactgatgagcaatttggaatgccaacagttttagacattttcaaagagttggaaaaacccggaagggatcctcgaggtcaatttaaaacggcagtatttatggacggtgttgaagaaatcactgacttaaaagcaggtatgattttagaaggatctgtaactaacgtaacgaattttggggcatttgttgatatcggtgtgcatcaagacggtttagttcatatttcatctctttccgacaaatttgtggagaaccctcatgaagttgtgaaaacaggcgatattgtgaaagtcaaagtgttggaagttgatgttgcccgtaagcgtattggactaaccatgcgtttagatgagaatccgcccaaaaccgaccgcacttcagtcaaaacgacctcagtccatgtaaaagaagtgaataaaaatcggaaaagtagcaataatgttatgggaaatgcgtttgccgatgcgttaaaaaattggaaaaaatagttttagtacagggtatttgggtattaagttatgatgggtttaattatataacacaggaaattttatatgaataaaaacactttttttgtaggctttatgctgtttgctatcttttttggtgcagggaacttaatttttcctcccaagttgggatttgatagcggatctgaatttattccttctattttaggctttgtattaacaggggttggcttaccgctattgggcatcgttgttagtgcattttataatgggggatacaaagaggcacttaaacaaattcatcctgcattttcattaatttttttaattgcgatttatttatctatcggccctttttttgccggaccaagaaccggtgcaacagcttacgaatttgtgattctaccttttatgggggaagcaacatcaatttctaaactggtattctttgcggtctatttttcattgactttatggctaagtttaaatccgacgaaattagtcgatcgtatcggctctattttaacgcctattttattggtagcgattatcgcattagttatccgttctgtttttttattaagcggacatgatattccaagtgtaacggtgaatacatcaggtagcttttttaatggcgtgattgagggctactttactatggatgccctagcatccgttgctttttctgtggttgtgttaaatgctatacgaaataaaaccgacctaagtgtttcattaaaacagcaaacaatttttgctgcatttattgctgccattgccttgggtttaatttatgtagcattaggatggattggtaacaatatttcaattaatgcggatgtattagctgatttgcaagcgaaaaaacaagaccttggtacttacattctaaacgatgtaactacattagcttttggtgagttaggtcgtacgttgttaggaattatcgtttctcttgcttgtttaacaactgcggtaggattagcggttgctgtgagcgaatattttaatgagatttatccgaagatttcttacaaaacctatgttgttttattttgtttagtgagttttgtaattgcaaatttaggcttaaaagaagttattagtttatcattacctgtattgctaatcctttatcctattgcaatgacagtgattttgttgctttttgttaatattattttcccgacgccaattttagctcatcgcttatctttaggattggtgactgtcgtgtctgttttatcggtatttggggttggaaaaattgagtttatcgagcaacttccactaaaaccttactctatggaatggctaccttttgcattggttggatttattttaggatgttttttacacatattcttcagtaaagaaaaatcagtgttaaaaagataagatataaaaatgagggcatattcaatgcccttattttctagtagtaagagtgttcgccccgctggtgttcagttacgtcttttacacctgtcaattcatcggcaaacattgctaataattgtttttcaatgccgtcttttagggtgacatctaccattgaacagccattacaccccccgccaaattgtaaaatagccttgccatctttggtaatttcaatcaaggtaatatgcccgccatgtcctgccaattgaggattgatttgcgtttggatagcatattccacacgttcaatcaatggtgcatcatcagctactttacgcattttagcattaggtgcttttaaggttaattgagaccccatttcttcagttatataatcaatttcagcatcttctaaaaaagggaaactgacttcatctatgaaagcagaaaactcactgtattttatttcatgatctgttgtttctacggcatttttagggcaataagacacaccgcattctgcattaggagagcctggattaacgacaaaaattcggatatttgtaccttcttcttgttgatctaaaagacgacgaaaatgtgcttgtgcagcctctgaaatggtaatttgcataaattaatattcctagcaatacttgagtaaaattatcaggaatgatactcctagaccgctcttttttccagtaatattacttagtttttatgttaagtttttgccagtccccatacatgaataacgttaattcctgcttgttttaatagttttgctatttcatttaatgttgagcctgttgtaataacatcatcaattaaagcgatggaatgatattgttttgctcgcttaatattcacgctaaaagcgttgtgtaaattagatcgtcttgctttttcatttagtcctcgttgcatttttgtgtatttttggcggacaaccagtttattatccagtggaatcgaaagttggcgtgaaagttgtttagcaattaagtacgcttgattataccccctgtaccattgacgaaaatgatgtaacggaacaggaatgatgacttcaggcaaactgaataaatactctcttcttgcatggtaaatcgctaacaacattaattgtgccaaagtgcggtctaaataatagcgattttgaaatttgaattgatgaataagtgtggataaaggtggttgatagcgtccaataactaccatttgttgccaatttggtgattgttttgcacaattcccacaaaacatctgtcctctaaaggcttgattttttgataaaacagcaccacaacgtccacaataatttaagcgagaaatttgtttatcacattgataacacaaatgacggtgtgcaaaatttaacggtttttgacaatggacacagctaaaattaaaccagttcacttaagttataacctccagagtggaaaaaagtgcagtattccattcaggaaaatatagatcaaaagattagggataatttctcgatcttaatcacaaaaatgctagaattagccaggctaaactaatcattttatgaaggaaaatttatgtctttaactgactatcgtgaaaaaattagcatggtattttttgatattgacgaaaccttattttcaaaagaaaaagatcatttaccggcaagcacttattttgcattaaaatctttgcgtgaaaaaggtgttttggtaggtattgcgacagggcgtgcacgctgtacttttcctgccaaaatcaatcaaatgattgatgaattagggattgatatttttgttactgccaatggacaacatgttgagtatcaggggcggatattagcccgttatgcaattgacaaaaataaattgtacaaactggttgagttttttgatcaacatggcattgattatgttcaagtagcgaacactgagattaaaatttccagcctcaatccaatactcactgatgcttttaatccaattagtacgaattatcaagtagatcctcgttattttgaacggcatgatgtattacaaattttgtcattctatgaggataaaagctacgatgaattaattgctcaatctaatattttagaaggattaaagacagtgcgttggcatcctaattcagtggatatatttgataaagacggttcaaaagcacggggaatccaagttgttgttgagcatttagggttgaatatggaaaatgtgatggcatttggtgatgggcttaatgacatagaaatgctaagtgcggtcggtgttggcgttgctatgggaaatggtcatgaatggttaaaacaacaagcgaattatgttactgatcatattgaagaaaatggcatttataattttttacataaagttggtttggtgtaattttaacaaggttaaataacttataggtcgctttttattttctcggcatcattatcctcagtaagaattcaccgcacttttctattagctatgataaacttattgcccttttaggttgatgatgagtgtttatgaagaaaattttattcattgtattgttgtttttgtgtggtgcaggcggtagcgttttttgggcatattggcaaataactgactttgtaaaacaacctgttaaagtcaaagaagagcaacttttaactgttgtgcgaggaacgaccggcaataaattggcaatattattagaaaatgaagggttaatcgaaaatgggaaatggttgccttggctgcttaaattaaaacccgaattgaataaaattaaagccggtacttattccctcgttaatgtagaaaatattcgagatcttcttgatgtacttaatcagggcaaagaggtgcaatttaatttgcaattgattgaaggacaacgttttaaaacttggcgtaaaattttagaaaatgcaccgcacttgcggcaaacattacaaggaaaatcggagaaagagatttttactttgctggagttgccggcttattcaaaagctgtttatgaatggaaaacgattgatggttggttatatccggatacttatagttacacgcctaactctagcgatttggcactgttaaaacgtgcggcttcccgtaccataaaagcgttagagcgagcttggcaacaaagaaatgtaaatttgccattgaaaaatccctatgaaatgttaattcttgcttctattgtggaaaaggaaacagcattgagtgaggagagagcgaaagtagcgggcgtttttgtgaatcgtttaaataagcaaatgaaattacaaacagatccaacggtgatctatggtatgggtgatgattataaaggtaatattcggaaaaaagatttattgacaccaaccccttataatacctatgtgattgatggtttaccgccgacgccgattgctatggtaagcgaggaaagtttacaggctgttgctaaaccggaacagcatgattatttatattttgtcgcagatggaagcggtggacacaagtttagtaaaacattggcagaacataaccgtgctgtgcaagaatatttgcgttggtaccgttctcaatcaaaatagtgaaataaaatgaaaacaggaaagtttattgttattgaaggcttagaaggtgcaggtaaaagtagtacacatcaagttgtggtaaatacattgacggagtttggtattcatgaagttatttttacccgggagccgggcggtacgcctttagcggaaaaattacgttatcttattaaacatgaagccgaggaacttgtcacggctaaagcagaattgctcatgttgtatgctgctcgagttcagctcgtagagaatgttataaagccggctttagcaagaggcaaatgggtagtgggagatcgtcatgatttatcttcacaggcttatcaaggaggcggtcgaggtttggatcggcatttgatgacaacgttaaaaaatgctgtattgggcgattttaagcccgattttacgttgtatcttgatattgaaccagaaattggtttagcgagggtaagagggcgaggggagttagatcgtattgaacaacaaaatttagatttttttcaccgcactcgagcaaggtatttacagttagtgcaacaagatcctaatgccgtattaattaatgcagatcagcctattgagcttgtgcagcaagatattcgtaaagctgtgcaaaaatttattgaagaaaatgtgtaatttatatccttggttacaaccttattatcaacaaattatccaaccttttttacaagagaaagggcatcatgctttgttatttaaagccgaacaaggaataggtatcgagcaattgattgaaaatatcgcaggttggttaatgtgccggcaaaaagatgccctacaatcttgccgacaatgccaaagttgtgcattattcagagcaggaaatcatcctgatttttatcgacttgaatctcttgacaataaggatattggtgtcgagcaagtgcgagaaatgaatgaaaaagttagtcagtttgcaaaacaaggcggaaataaagttgtgtttattcgtcaagctgaacgtttaactgaaagtgcggcgaatgcgttactaaaaacgttggaagagcctagaccgcatacttattttttattacaaatggacttttcggctgggttgttagcgacaatttatagtcgttgtcaagcttgggttattaatacgccaacagagcaacaaggtcttgtatggttgcaacagcagcgtcaggaaaaaatcgcagatttacaaaccgcacttcgtattaattataatcgtccattgctggcattggattgtttggaaaaggggttattggaacaacgaacgacatttttacgtcagttttggttgttttatattcgacgttctcccttggagttattaccgcactttacgaaagaaaatgttttattacaactggactggatgagtgcatttttacatgatgcactcaaagaaaaattaggtgttcggcaaggttggatcagccaagatttagctcgtggcattttgcaatttaatgaaaagcaaaatgtggaagagttgttaaaagcaattcaaattatccaaaaaatgcgtttgaatctaacgcaaatcaatggggttaaccaagagttaattttattagagggattgactcgtttggtaaccgatgtatttgaaaggaaagaataggaaaagaaatgtttattgtggatagtcattgtcatcttgatgccttggattatgaaaacttacatacagatattgccgatgtggtggataaagcaaaacagcgtgatgttaaacatttattggcagtaggggtaactttgaatcgttttgagcaggcttatgcacaattagccttatttaaggaagtttccctcgcttgtggtgttcatcctttggatttggcggaagaaccttttgattatcagcgtttattgaggttggcacaagatgaaaaggtagttgcgataggcgaaaccggattggattattattacagcattgaaaataaagctttgcagcaatctgtttttgcacaacaaatagagattgcaaatcaactgagtaagcccgtgattgtacacactcgatccgcccgagacgataccattgccattttgcgagaaaataatgcacaaaagtgcggtggtgttttacattgtttcacagaaaattggggaatagcaaaacaagcacttgatttagggttttatatttcgatttcaggtattattacctttaaaaatgcacaagagttacgtgatgtagtacgtcaagtaccattagagcgtttgttagtggaaactgatagcccttatttagcaccagtcccgtatcgaggtaaacaaaatcagccggcttatacacgtgaagtttgtgaatatgttgcaacattgaagggattatcagcggaagactttgcacaaattactacgcaaaattttgagcgtttatttaagattaatgtacaataaagcaacaatttacagggggagttatttatgagaaaaatatttaaaaaggtagtgttggggttactattcttattccatgtttttttattttctgtggtgcattatgttacgccacattatgatgttaccaaagttaccggtgtagaagttaagagagttgataaagatggacctattactaaagctaatccggctgacggtccgactcgtgatgtgtattatatttacacgcaaaaaccgaatgaggaaaacgtgatggtgtatcgtaatgaagatacacgttggagttttccattttattttaaattcggttccgccgatttacaggcaaaagcccaaagtttttcagtggatcataagttagtggaaattaagtattatggttggcgtttggttatgtttgatgaattccgtaatgcagtgtcagtcaaagaggtgagtgcggatacagaagcttctcattccattttagcttatgttttttacgcatttttattgattacgttatttttctctatccaatttgtgcgtggttggtttgatagtgaagattaactttttggtttgatatgcttctattctcatcagaagctactttgttaggcattgaatattatgagtttattacaggcaatattagtcattattggcttaattattattagtgcggtcgtttcttccgctgaaatttcgttagccggttcacgtaaattgaaattgcaaatgttagcgaatgagggtgataaacgagctgtgcaagtattaaaattacaagagcaaccgggacgttttatcacagttgtccaaattggactaaacatggtggcaatttttggagggattgtgggtgaaagtgccattcgcccttttttacaggagattttaagtgcttatacgcaatctttttgggtagaaagtgcggcttcttggctggcttttattattgtcactgtttcttttgttctcttcgctgatttaatgcccaaacgtttagcgatgacaagtccggaaaaagtagcattgtcaacagtaggaataatgtctttttgcattgttatttttaaaccagtggtcttaatttttgatactattgcgaacggaatttttcgcttattgggaatttctaccatgcgggaagagagtatgacgccagcggatattgtcgcaattgtagatgccggtgctgaagcaggtgtattaaaagcacaagagcattatctgattgaaaatatttttgaaatgcaagagcgtacagttacgtcaactatgacgactcgtgaaaatattgtgtttttagaccgctcttttgagcgtgagcaagtcatcaccacaattaaaaataatccacattcaaaactacttatttgtgatcatggcttagataaaattttgggctatgtggaaagtcataatttattaactttatatttgcaagaacaacaagtttctttaaccgagcctagaattttacgaaaggcattatttattcctgatacgctttccctatatgaagtattggagttgttcaagtcttctggtgaagattttgctgttattgtaaatgaatatgctctcgtagtgggaattgtgactttaaatgatgtaatgagtattgtaatgggcgaattagtttctaatgaggaagaacaaattgttcgccgtgatgaaacatcttggttgattgatggtgcaactcccttagaagatgtagcacgggcattggaaattaatgagtttccggatgaagaaaattacgaaaccatagggggatttatgatgtatatgctacgtaaaattccgaaaaagacagatttcgtattatatgatagatataaatttgagattattgataccgagaattttaagattgatcaattgatggtatcgctaagaaaggatatttagacaagattcaaaagagagtaaaccacatcttcgctttctttagatattatcagtcaaatgcaattaatgggatttttcttataaaaatagaaggttatgtaaaagagataaaaagcaatccgaagattgcttttttgttccgcttattgagcaagtgcacgttttaattttaggatagtcgccttccctttatcttcatcgacttgtttaagattggctccgccaacaaatgcaccgggtttaatatattggcgaataaaataattttttccgccatctgtcgtaatatcaaggtgattatcactaaactctgattctgttgagagcctatgattacctgggattacacgcttgtaaaaatatgttttgggtgcggattcaccaataagtttgccatcgatataaagattcttcttcaacgcagctccaaatattgaatcacgataaatataaatccctgattcatcctttgatggaagcaaaaactgtttagccaaagcatcattttcaggggtatccatcaccgttctggcacaaccggtaagtcccaaagtgattgccagcaagagagttgaaaaaaatttcatttgatgtctagcccatacgacttagaagtaataacttgcactcaatgacaagctttgtggcttgaagcgaatatcgccttttatattgcggaggaagactttttgatattcaacacccacatcaaatttatccgttacggcatattttacccctacagcagtaccaataccgacaacagagtttccttttatggtgcaactatcacaaattttcttggtattaagatcataaaaatgactatttaaactcactttaagatacggcatgaaattgttactaatgcgatagccttgaagatagccgacactgaaagaaaatttttctttggatagtagttcgttattagaagtgatttttgaaccgccggtacgtaattttacttctgcctgacctacaaaattactgtcaccaaaattaaagccgtaaccaccgaataaaccaaagcctattttgcctgatttttttttggtttcgctttttgctgtgctagaaagcgtaccctcataaccatgttttgaatgatgaacttctccacccataaaaaagccagtgaaagtatcttgtgccattgcaccacttgccatgcaagataataataccgttgcagctatagatatttttttcataaataaatcctcttaataaagattaagttaaatttgaaactattttattgttaagagaaaactaagtcctaagatcttaattttcaaagatatattctacataggtatattatgagtaccatagacaaataagacattattagtctaataagtagaaaaatagtctaaaaagaggaaatgaaaaaattatttacatattgtctgaaagtatttaaacgaaaagagcggtgtaaattttaaaaattcgtaccgctctttttctatatcagttacttaaaaagaatattcatgtttctgcgatgttgcagccggtattttctattaagaattataatttaggctcaccaattggtaatatggttttaccaaaactttcattgataatatcagcagcagcgagatagaacgctaaaagtgcggtcaataaaccaaagtttccacctagttggctaaagttgtgattaccggtaaaatcgcctacagcaagtaagtagaaggtgatggttaacgctaagaaaatagcctgtaatgcacgagtttttgctaatgtgccgataaacatcatcaatgtgaatgttccccacgccgctaagtaccagcctacaaaagatgatgtgacaccttgtgagaaaaatactttgaataaggcaaaactccaccaaaatgcaccatagctggtaaacgcagtaaaaccgaaagtattaccttttttgtattcaaacataccggcgatcatttgggctgtaccaccaaacgcaaatcccatggctagtactaaacctaaattttcaccgctgaacataccgttattgattaaacttaataaccaagttgttaatgcaaacccacataagcccaatggtgccggattcgctaagttatcttttgttgtcgacattatattttgcccttaaattaatttgataaataaaaaaggcgttattatctatgattttattgaataaataaagattggtatgaaaaacgctaggataagaacaatgaaattgggaaagtagctagaaaattaattattttttgtttttcgctattgttatttagatgtaaaatacgttcagctgagttttaagggtaaaatacgatgagcgtttagtcgccacttagtctgcaaaatgcgaaatgttaaatcacaagcatgtgagtttaaggattggtaagaaatgttatcatcaagttaaacgtcagtttctcgtttttacgcctaaagttgctggagcacatcattggacacaggtaagctcgacattagaggggagttagaataaaacggatttcgttttctaacagaagaaagtaattgtttttaaaaggaaaatttgttgaatactcaatctaagcaaaacgctagttttgtttttattttaaccttaggcattttatcaatgttacctccacttggagtggatatgtatttgccggcatttttaaatattgcacaagatttgaaagtaagcccagagcaagtgcaacatactttgactttttttacttatggtttggcggcggggcaattattttgggggcctgtgggagatagttacggacgtaaaccggttattttattaggtgtgattgttgcgactattacagcatttattttaaccagtattaataatattcaaaatttcaccgcacttcgttttattcaaggcttttttggtgcggcacctgtggttttatccggtgcactattacgagatttgtttagcaaaaatgagctttctcgaatgctatcgatgattactttagtgtttatgattgctccattactcgctccaattattggcggtaatttgatgcgttttttccattggcatgcaattttttatgttatctcggcaatgggaatgctaagtgcggtattggttttttatgttattccggaaactcataaaaaagaaaatcgcattcctctcagattgaatattatcgcacgtaactttttttctctgtggaaacagaaagaagtactgggttatatgtttatgtctgcttttggttttggcgggttatttgcttttgtgacagcaggttcaatcgtttatatcggactttatggtatagccgttgaaaattttggttatttctttatgttaaatattggggttatgattattgcctcttttatgaatgggcgattggtgtttaaagtgggtgctgaacgtatgctacaggttggcttgatggtgcaatttatcgcaggtctttggttagcattcgttgcgttttttgatttaggtttttggtctatggcaattggtgttgctttttttgtagggcaaaatccattaatcagttcgaatgccatgacatctattttagagaaatttccaactatggcaggaacatcgaattctatggttggaagtgtgcgtttcggtatgggggcaatagtggggacaattgttgctttatttgaaatgaaaacggcagcaccaatgcttttaacaatgacgatttgttctttgcttgcggtaagttgctattattttttaacttaccgtcatttaaaaaaataaaggaagatcatggcattgcaaccttgccctgagtgtcggcgtaaaatcagtgagtgtgcgataagttgtccacattgtggtttttcgttgcaagaagaaaattgggtgctatatcgtgaaaaactaaaaaaacattgtcagtataatcaggaaattaatcgaacaagtgttagaatccatttattttggttggtagtattttctatagtaattgggatagcaggctggttaagtaattagtcgttaaaagatattcaagcccctgtaataaggggcttttttgtatggtttaactttttgttttcattgctggaaataaaatcacatcacgaattgagttagcgttggcaaataacatcgctagacgatcaattcctaaaccctcaccagccgttggtggcaatccatgctcaagtgcggtaacaaaatcttcatctttaaacatagcttcatcgtcaccagcttcttttgctgcaacctgtgcctcaaaacgctcattttgatcttctgcatcatttaattctgagaaaccgttaccgatctcacgtcctccgataaataattcaaagcggtctgttacgtcaggattttcatcattgcggcgtgctaaaggggagatttctgccggatgagccattaagaaagttggttgaattaaatgatgttcagcaacttcttcaaaaattgcattgactaagctacctagcccccatgatttttgtacttcgatacccaatttttgtgctactgcgacagcacgatcgaaatcgtataaatcttctttcacaataccttgctcggcaccgtattttaagattgcctcgtgcatggtaatacgttcaaacggtttgccgaaatcgaattttaaatcgccgtaaggaacaatggtcgtacctaaaatatctagtgctaatttgcgtaaaagttcttctgtattgtccattaaatcgtggtaatccgcataggcttggtagtattccaacatagtaaattcagggttatggcgaatagaaacaccttcattgcggaagttacgatttaactcgaatacacgttcaaaaccgccaactaccaaacgttttaaataaagttcaggtgcaatacgtaaatacatatccacatctaacgcattgtgatgagtaataaatggacgtgcagatgcaccgccaggaataatttgtaacattggcgtttcgacttccataaatcccttggaaatgaaatattctcgaatacctgcgattactttagatcgaataataaaagtgcggcgtgaatcttcattagcaattaaatctaaatagcgttgacggtagcgagtttcttgatcgctcagtccatgaaatttattaggaagtgggcgtaatgctttagttaataattgaacttccgttgcacgtattgtcaactcattggttttagttttaaataaagtaccttttacaccaacaatatcccctaaatcccaattgcccacatcatcagtataaacaccttcagctaggttatcacgagcaacataaagttgaatttttccgctcatgtcttgcaatgtgataaaggttgctttacccatgacacgacgagtcataatacgccccgccacttttacttcaattccctgtgtttttaagctctcactttcaatttcatcatattgtgtatgtaagtcctgtgctaaagcattgcgacggaatgtatttggaaaggcgttgccttttgctcttaacgcagctaatttttcacgacgaaccaacatttcgccattgagatccaattcttgaattatttctgtcattatgtactcctcttggaaagtcacgtgtagaataaatttgtcatttgaataaaatattgtgttttttgaccgctctttatagtccggcttttaagctggcttcaataaaacgatccaaatcgccgtccaatacagcttgagtattgcgattttcaatacctgttcgcaaatctttaatacgggaatcatccagcacataggagcggatttgactaccccagccgatatcagatttactgtcttccatggcttgtttatcagcattttttttcattatttccatttcgtacagttttgcttttagctgcttcatggcttgatctttattctgatgttgagatcgtccattttggcattgcaccacaataccgctaggaatatgagtaatacgcaccgcactttctgttttattaacgtgttgtccgccggcacctgatgcacgataaacatcaatacgtaaatctgcaggattgatttctatttcaatatcatcatcaatttcaggataaacgaaggcagcggcgaaagaagtatggcgacgattattggaatcaaatggacttttacgtactaatcgatgaatacctgtttctgttcttaaccaaccgaaagcatattcgcctgcaatacgaatagtggcagatttcaagcctgcaacatcgccactggaaacctcaactaattcggttttaaagcccttgctttctgcccaacgtaaatacatacgcaatagcatttctgtccaatcctgagcttctgttccgccggagcctgcttgtaggtcaacataacaatcacagttatcatgttgtccgctgaacatacgacggaactcaagggcggcaagttttttttccaattcttccgcttctgcgacagcttcattaaacgttgtttcatcttccgcttctacagacagttccagtaagccatcgacatcttccaaaccttgctcaagggtttttattgtattaacaacaatttctaaattagaccgctctttgcctaatgcttgagctttttccggctcattccaaatatccggttgttcaagttctgcatttacttcttctaaacgttcaacttttgtatcaaagtcaaagataccccctaagcatatttgtacgctcagtgagatcgattaatttattttttatcggattaatttcaaacatagcttttcccaatgataacaagtgctgaattataagctattttgctgatgttgggtagttgcagattagattgttcaaaggatttatgttagaatttcgtccgttttttactgaaaattaggaacttaaaatgaaaaaatttttaatggtaagtttagccatgttgatgtcaacttttgtaaaggcagataataatgtcacaattcgcaaaaatttacaaaaattaggtatgactgatgtagaaattatggagtctcccattaaaaatataaagagtgttttgacccgtgaaggtactctgtatgtttcggaagatggtaaatatgttttacatggtgctttgtatgaaattactgacaaaggtattgtgaatttaacgacaaagtctttattggtaaaactgaataacttaaaaaatgagatgatagtttatccagcgaagaaggaaaaatatgttattaccgtattcatggacattacttgccattattgtcatttattacatcaaaaaattaaagaatataatgagttaggtattactgttcgctatttagcctttccacgtgctggtctacatagcaatacagcaaagcaaatggaagcaatttggcagtctaaagatcctgttttcgccttagatgaggcagagaaaggtaatttacctaaggaattgaaaacgccaaatatgatccaaaaacattatgagcttggcattcagtttggcgtaagcggtacgccaagtattataactgaaagcggcgaagtgattggtggttatctagagcctaaaaaattattgcaagcgttagaagatattcgtgaataagtttattaaacgacgtgatgttgcgacagatgttcaagtttgtgaacatcctttattggaccgaatttatcgtgcacgccaaattaagaatccgcaacaattagaccgcactttgaaatctatgttggcacctgatttgctacatggtattggaagtgcggtggatttattggtaacagcgagagaaaaacaacaaaagattgttattgtcggtgattttgatgttgacggagcaaccagcacagcacttattgttttggctcttcgtcaacttgggttcacagatgtagattatttagtacctaatcgctttgagcaaggttacggtttaagcgtggaagtagctaaattagcattagaaaaaaatgttgagttattgattacagtagataatggggtatcttcttttgatggtgttgtgtttttaaaaaatgcgggagtgcaagtgttgattacagatcaccacttaccgccggaaatattgcctcctgcccatgctattgttaatccaaatcttacacaatgtaattttccttcaaaatttcttgctggtgtcggtgtcgctttttatgtcatgctggcattgcgtgcaaaattacgtgatttagggatttttactacgcaaacccaaccgaattttacagcgttattagatttagttgcccttggtacaatttccgatgtagtaccgcttgatcaaaataatcgtattttagcttatcaaggtttagccagaattcgagctgagcgttgtcgtcccggtattcgtgctttggcggaaattgcaaatcgtaatatgagtcgattgaccgcttccgatttaggcttttctattggtccaagattgaatgctgccgggcgtttggacaatatgtctgttggtgtggagttattattggccgatgatatgcaacatgctcgtcaattagcttttgaattagatagtttgaatcaggctcgtaaagaaattgagcaaggtatgaaacaggaagcgttagaaatttgtcggaatttgaccgcactttctaagcaattaccgctgggcatcgtactatatcaggttgattggcatcaaggtgtactcggtattttggcttctcgaattaaagataaatttcatcgaccgaccattgcgtttgctcaggatcaagtcggaattttaaaaggttcagcacgatctattgaaggtttacatatgcgtgatgtgttagagcgtattcattctcgctatccggatatgattttaaaatttggtggtcatgcgatggctgctggtttgagtattcgtgaggaattgtttacacaatttcaacaagcctttattcaaactgtgactgaatggttaaaagaagaacaattacaaggtattatttggactgatggtcaattagcacccgcgtttttaaatttggagacagcggaattactgcgtcaagcaggtccttgggggcaaggttttccagagccgtgttttgatggtgaatttacaattttacgccagagtattgtgggtgaaaaacatttaaaaatgcttgttgagcctaaacaaggaggtccgctgttggatgctattgcatttaatattgataaggattactaccctgatttttcgataaaacatgcaagaatagcttataaattagatagtaatgagtttcgtggaaatcgtcatgttcagttgttggtagattatattgaacctttagatcattaaatttatttttcggcactggtacataataatgttttagggacaataaaaatgacagaagaatatggcgtatttacttatccctatgtcattattaatggtaaatatgttttgacagcaagtactttatataacgatgattatagtgttgcagtgcttgattttttaattcatcaaattcaagtggagagcaggaaatgaaagtaggtattgttggtgcgatggcacaagaagttgagattttagcgagtttaattgagaataaaaacgtagttcatattgccggctgtacaatttatcaaggaaacattcaagataaggaggttgccttattacaatccggtattggaaaagttgcagcggcaatgggaactacactattattgcaaatgtttaagcctgatattgttattaatacaggatctgccggcggcgtatcctccggattaaaagtgggtgatgttgttgtgtctactcaaactgtttatcatgatgctgatgtgacagcctttggctatgctaaaggtcaactgcctgcttgtcctccagcttttatttctgatccaaaactgaccgcacttgttgcaaatgttgcaaagcaacaaggcattaatctgacttccggtttaatttgctccggtgacagttttattaatagtgtagaaaaattagcttggataaaagcaaattttccagaagttgttgctattgaaatggaggcaacagctattgctcaggtatgtcataaattcaatattccgtttgttgtcatacgggcgatttctgatgtcggagacggtgaagcaagcatgtcttttgaagagtttttgcctttagcggctaaacagtcttcctctatggttctaaatatattacaaagtttgtagggaattgattaattataaatatcaacttgataaataaagaaaaaatctccaaattgatctgcacyccmaaagttggactaaacmryyaacwagttarggtrcagattttttatgactaaatataaycaatcttttaamcaacaagtgatygaattttatcttcaaaatggggaaaatcgttcactgacccgtcagcattttcagcttgagaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacggaatgttatttcggcaagcgtttgagacttttgaacaacttgaacagacgattcacaactacattcattactacaataatgagcgtattcaagtgaaattaaaaggactaaaccccgtggaatacagaactcagtccttgaattaaatcagtctaacttttttggggcagannaattcggagattttttgttttggattattttgagcttggaatgctgaaacgcttgttgaaacgttctacacgaccgccggtatcaacaacacgttgtttaccagtatagaaaggatggcagttgctacatacgtccaagttcaaatttttacccactgttgaacgagttttaattacgttaccgcaagagcaagtcgcagtaatttctttatattcagggtgaataccttgtttcatagaaaacctcttaaaaatcactccgctctccaaaaccgaatttggcaccgagtgctgttaatattacgccatctaaaggcaatttagtaagatggcagattataccgaaaaaatgggctttttcaagttatctgtataaaaaaccgcactttatccttgcattttaaagtgcggtataatttgcaacaattttttacattgctgtccaaagtaaaatggcaagcaactgaggcgacataatacgcaggaacatagaaagcggataaacagtagcgtaagataatgcagctataccgctatcttctttaattgcattggcaaaagccagtgcgggaggatcagtcattgaacctgcaagcaaaccgcataagctgagatagtttaatttcatgtataagcgagcaataatgccggtgatcattaatggaataaaggtaatgaacataccatatcccatccattcaagtccttgaccattaaccagtgtgtcaacaaatccgcctccggattttagtccaacaacagctaggaataaaacgataccaatttcacgtagtgctaagtttgcactgggcggcataaaccaatagagtttaccgacactaccaatacgagcaaggattagtgcgacaactaatggacctccggctaaacctaattttaatgctacagggaatcctggaatgtagaatggaattgagcctaatagcacgcctaatccaattccgataaataccggtaacatttgcacttgttgtagtttttgttgtgcattgccaataattgaggttgcatcaccaattgtatcggatcgccctacaatatgtagcacatcgccaaattgtaatgcggtgttggctgttggaactaactctacgccggcacgatttaaacgtgaaatcacaacgccatattttttatgaattcctaagtgttttatgcgtttaccaagcactttttcattggtaacaacaatacgttcagagcgaagatctcctgctaaatgagtcataggcatatcaatttcctcacctatcaccaatttcatttttttcaaagcattgatttcaccaactaaatgtaatacgtcatcaattgctattatggtatctgcacttggtacactaatattttcttgtcgttttaaacgagaacaaaccacatctttattgtcaaagccgggaatatcaattaatcgtaaaccacttaaatttggattggtcactttaacatttactgttgttaagctttctttatcctgtccgctggctttttggaattgtttctcttcttcttcaaccttaattttaaaaaataaacgaattaaccacatgctaagtaaaatgccgcaaatcccgaaaggataagccatagcgtacgccatacccattgtgctgttagcattttctatgcctagttcagtgagaatttgttgacccgcacccaaggatggcgtattagtgaccgcaccggagtagataccgagaataatatcaagatcaacattaacaactttatataggacaaaaacacttactgcaccgagaacaacaattaatgttgctaagccgttaagttttaaaccagcagagagtagagaggcaaaaaatcccggaccgacttgaatgccaatggtataaacaaatagaattaacccaaattcttggataaagtgtagagtgtgtgcatctaattttaatccattttggttcataaaatgagcgacaataattccaccgaataatactcccccgatgcctaaaccgactccgcgtattttccaatgccctatccataaaccaataacggcaacaagggctaggatacaaattgtgatagcaatatcactcataccgacctcttttaaagttaaatataaaaaatagctactcgaattatatcaagctcaattcaaagaaacgataaaaatctaaaaaatgtaggatttatcacatttttcttgattaagttatggtttttattaacaatatttgaaaaaaattaaattttatttaatccctttattataagaggcgttgagaatacaaaatgaattggtcggaagaactttttacatcgttactttggatagtgaaaagcttagttatagcaagcttggttttctctttaattttatattttttgataaaaatgacccgatggggacatcaattttggctattagcgaaaagttatttatcaccacgtcgtagccttatacctttgtgttatttttgggtaatcgttttttttgatttattagccgtgcggttagatattttattttctggttggtataagtccatgtatgatgccttacaagaaatgaatgtagctagattttggcagcaaatgattgttttctctcttttagctgcggttcatatatgtaattttttattcacttactatatttctcaggatttcaaaattaagtggagaacttggcttaataatgaaatgttagataaatggtctgaaaatcaggcttattataaaacccagtgccttgctcatcaattggataatccggatcaacgtattcaacaagatgttgatgcctatgtttctaattcattaaactttgctacaggtgttatttcttttacagtgtctttagctgcatttaccgtgattctttggaatttgtcaggcccaatggtaattatgggctacgaaattccacatatgatggtattcttagtgtttatttatgtattggtgagcagtgtaattgcttttagaatcgggcgtccattgattcaattgaattttgctcatgagcgtttaaatgcaaactatcgttattcacttattcgtttgaaagaatacgcagaaagcatagcgttttatcgaggagagaatatagaaaaatcgatactattacgtcaatttgaaaaagtcattggtaatttgtggcaaataattcaccgcactttgaaattatttggctttaacttagtggtttcacaggtatcagtcatttttccatttattattcaggcaacccgttatttttccggacagattaaattgggggatttagtacaaacctcacaggcttttagcaaggttcagtcagcattatcgttttatcgaaactcctatgatgattttgccgcctatcgagcagttctggatcgtctaacaggtttccatagtgctattgaagcagctaatcagccatcaaaaacacaaattaaacctcatatgtcagcggttatttttgagaatttaaatattaatacaccggaaggaaatactctcattgagaagctgaacttaacaattgagcaaggagtttctttattgattaaaggtaaatcgggtgtagggaaaacaactttattgcgtacagcagcaggtttatggccgtattcagaagggcagattttttgtccacaacaaacattgtttctagcacaaaaaacctatttaccacaggggtgcttaattgatgctctttattatcctgaaccagttccagccgacattgacgcagacaatatcagtaacattttgcaaaaagtgcatttgtctcatctggttgacaaattggatgtagaaaatgattggacgagagtactatctttaggggaacagcaacgtgtagcttgtgccagagtattgttgcataagcctaaagttgttttcttagatgaggctacatcaagcatggatgaagggcttgaagatgcgatgtatcgcttattattaactgaattacctagtacaactttaatcagcgtgggacatcgttcaactttgcataagtatcatcaattacacttgcagatcaatagtgataaaagttgggacatgatgaaacatacagaaacattttagcgtaaaacatatttgttaatttgctgaatgaaatgtatccattgatgttaagtcgatggatttttttatgggttaaatttgatatagatcaaataaaattgatttttatttgcaaagtattctcaataaaaatgagtttttttactagaaaaattaatgattaagcaggtttttcttacaaaatttatgtaaataatgcacaatatatagtggttgagtttttaaaagtaacaatatatagtgatttgacttttattaaacgcaacatataggtttatgtaaaaatgggttcattcttcgttattaaacgtgatggttcacgtgcagaatttgaaatacaaagaattattaatgctattaaaaaagctgcaagtgcggtcaatatccaagatgaaatgttctgtcataaaattggacaactggtctgtgataatatttttgctcactaccaaaaagaaattgatattagccacattcaggagattgttgaaaatcatctgatggctagcaagtatccacaagttgcacgagcttatattgaatatcgtcatgagcgtgatttagctagagagaaacgtagtaatttgactaaagaaatcgaaggattaattgagcaaagtaatgtggaattgttaaatgagaatgccaataaagattcgaaagtcattccaactcagcgtgatttattggcgggtattgtcgctaaacattatgctaaacgttatattctgccaaaagatgtcgttgattcccatgaaaaaggcgaaattcattatcatgatttagattatgcaccattctttcctatgtttaactgcatgctggtcgatttaaaaggtatgctgacgaaaggatttaaaatggggaatgcggacattgagccgccaaaatctattggtactgcgactgcggttaccgcacaaattatcgctcaagtagcaagtcatatttatgggggcaccacggttaatcgtattgatgaagtacttgcaccttatgtgcaactcagctatgaaaaacacttgaaaacagctgcactttggcaaattccagatcccaaagcttatgccgacagtttaattcaaaaagaatgttttgatgcttttcaatcgttggaatatgaagtcaacaccctgcatactgccaatggacaaacgccatttgttacttttgggtttggtttggggatcagttggcaagagcggttgattcagaaagctattttgcaaaaccgaattcgtggattggggaaaaatcataaaacacctgtttttcctaagttggtttttacaattaaaaaaggggtcaatcaaaattcaggagatccgaattatgatattaaacagctcgctttagaatgtgcttcaaaacgcatgtatccggatattctcaattatgatcaagttgtgaaagtaacaggttcatttaaagcaccaatgggatgccgtagttttcttggtgcttatgaagaaaataacgaattggtccatgatggacggaataatttgggtgtagttagcctaaatttgccacgtattgcattggaagcgaaaggcgatgagcagcgattctatacattgcttgaagcaaggttggatcttgctaaaaaagcattgatgacacgtattgcccgtttggaaaatacaaaagcacgagttgcaccgattttatatatggaaggtgcttgcggtattcgtttaaaagcagatgataatgtggcacaaatttttaagaacggtagagcatcaatttcgcttggttatattggtattcatgaaactattaatgcgttatttggcggtaaacacatttatgatgatgcaaaattacgtgaaaagggcattgaaattgttagttttttaagcgaaaaagtaaaacattggaaagcggaaaccggttatgcttttagtttatattcaacaccgagtgaaaatttatgtgatcgtttttgtcgtttagataccaaacagtttggcgttgttgagggcgttacggacaaagggtattacaccaacagctatcatttagatgttgagaaaaaggtcaatccttacgataaattggattttgagatgccttatcctcatttggcaagtggtggatttatttgctatggtgaatatccaaatattcagcataatttgaaagcacttgaagatgtttgggactattcttatgaacgagttccttattatggtactaatacaccgattgatgaatgctatgaatgtggttttacaggagagtttagttgtacaagcaaagggtttacttgccctaagtgcggtaatcatgatagtgaaaaagtctctgtaacccgtcgagtatgcggttatttaggaagcccggatgcacgtccgtttaatgctggaaaacaagaagaggttaaacgccgtgttaaacatttataaaaatcatcgctctttatgaattatctgcaatattatccgattgatgttgtaaatggcgaaggcacaagatgtactttgtttgtcagtggttgctcccatgcttgcaaagggtgttacaaccaaaagagttggtcatttagggctggagtattatttgatcgagagatggaagatcaaattattcgagatctacaggatagacgcattcgtcgacaaggattgagtttaacaggcggtgatcctttacatcctcgaaatattaccgcacttttgccttttgtgcagagagtaaaaaaggaatgtcctgataaagatatttggctatggacaggttatttattagcggagcttgatgaattgcaacggaaaatgttgccttacattgatgtgttaattgatggtaagtttgagcaagaaaaagccgatccaagtttgatttggcgaggatccgcaaatcaagtgatttatcgctttaatatttagcttttatacatattcttaaataagctcattcatatgtatggtgtggtgtattcaaattctatattgaatttgcataaccaatttcaacttaggtatttgtaacgatatagaatatatcagcaaattgaatattataaaaaaaccgctcataaagagcggtttttgtgcgaaggttttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttagcctttgtagttatgtacatgagcaactaaatctaagactttatttgagtagccggtttcattatcataccaagaaactaatttaacgaaagtatcagttaatgcaatacctgctgccgcatcgaatacagaagtcaagctacaaccgttgaaatcagtagaaactacagcgtcttcagtataacctaatacacctttcatttcattttcagaagcacgtttgatttctgcacagatttctgcataagttgccggtttttccaagtttacagttaaatcaacgacggaaacgtttggtgtaggaacacggaatgccatacctgttaatttaccattcaatgcagggataactttaccaacagcttttgccgcacctgttgaagaagggataatattttgtgccgcaccacgacctccacgccagtcttttgcagaagggccatcaacagttttttgggttgctgttgttgcatgaactgttgtcattaaaccgtctttgataccgaatttgtcattgataactttagctaacggtgctaaacagtttgttgtacaagacgcattagaaacaatgtcttgaccggcatacgcatcaaagtttacgccgttaacaaacattggtgttgcatctttagatggaccggttaaaacaacttttttcgcacctgcggtaatatgtttacgagctgttgcatcatctaagaataaacctgtcgcttcaacagcaacatcaacaccgagctcattccattttaaattagcaggatcacgctctgatgtaacacgaatcgctttaccattaaccactaagtttccatctttgacttcaactgtaccatcaaaacgaccatgagttgaatcatatttaagcatataagccatatattcaacatcaattagatcgttaataccaactacctcaatgtcatcacgagtttgtgctgcacgaaatacgatacgaccgatacgaccgaaaccattaataccaattttaattgtcataatattttcacctataatattttaagttaaacgaaactcgatgctttacagaagtgcttagtctttctagttttcacgctggggtagattatagcataaattcttctttgattatagtgtctctagagtaaatccggcatatatagattttttatgatccacgtcaaagttgataatgtttgtaccacattgattttttagtgtagtatgtgcggagatttatgtttcatcgttaagcggaaaatgacttttcatatggaaataggaagaatatcatgttaaccaaccaaccaaccaaccaaccaaccaaccaaccaaccaaccaaccaaccaaccaaccaaccaaccaaccaaccaaccaaccaaccaaccaaccaaccaaatgaacgtctattttccatagtaaaggaagtttttccgaaaagtcatagcataaatttttgtcttttagggggaatgacaaataagaattatctccttcatgtggataatgaaaaatatgtattgcgtctgccaggggtaatgacatcgaatttgatttcaaggcattatgaaatgaataatagtatattgatgtctcaggcagaatttaatgttgaaacaatttattttaatgctgataatggtattaaaataacgaagtttttagatggggggattaattttaaccataaaaatattcatcaatatgaatatttatctctcattgcaaaagaattatataaattacatcattcagatattcaatttaataatgcatttaatgtatttgaaacttttcaacaatattttgacttattaaaagataagaatagatttttttgttttaataaaaatattccattgatatacgaattttttattaaaatttcaaagaataattctttttataacatcaaatgtccttgccataatgaccttgttcctgagaatattttactgaaaaacaataaattattttttattgattgggaatattcaggaatgaatgctccgttattcgatgtggcggctttttttcttgagtcgagaataccagaagaaaaacaaaaatatttccttgctcattatgatcgttgcctggattttgagaagtctcgcatagaaatactatttcatcaatttacccaagatgttttatggtttttatggactttgataaaagaagaaaataatgaaacatttgaaaattatgcctcaataagaataaatcgtgcttatgaactgatgaaggatttggtgaaaaatgggtttatttagtgaagatcaacgattagttcatatcggttatttttgtggattattatccggtttattttgggcaatatcaggaatttcttacgaaaaattatatatagatttcccaatgctgaatgcgtttgcattaaatattattatattaagtattgctgagattactttgctgttaatggcttatggttatttgataaaaagaaaattattaccgcactttaataaggtttctttgttagcgattttgggaggttgtttgggtggtcctgttgggatgatttgctatttacagtccttacaatatgttggagtgagttatgcggcgaccatttcaatttgttatccaattatagcatctattttatccatcaagtttttagctgtgaaagcatcaagaagaacactattttcttttgtttttattgtcttattattaatgcctgtcatgtatcaaggtgaaaattcagaaatcaggattttaggcattatttttgctttttcttgtgcattatgttgggcacttgaaattgtgatttccagttatgtcatgcagcactatccatccgatcaagtttatttatttagacaaataggatcatcttcaggatattttcttattattcttttcatgtttttttatggaacttatgacaatttaattgattttaatttttttaaggatgtaaatctatggaaattggagtggatagtcattatttcctcaggattttcttattttctatattataaatcaattgcaattttgaatccaattagagcaatggcattaaatattacatatagtctttgggcgattgtattaagtgcggttcttttatcaaaggaaattagtatctttctgcttatgattggaataattgtattgatgaatatttttattgtggcgaaaggagaagaaaaatgaatgccattattttagcggcagggttaggaagtcgttttagagagattacgcagaagaagcataaggctttacttccgttacctaatggaattcctaatattgagcaaacaattatttatttaaagcaagcaggtattcatgagattcatattgtaacaggttattttgctgagcagtttgattttttaagtggtaaatacggggttaatcttatttataataagttttataaaaagtacaataatatctattcttttcattgtgctattgagcatttcggagaaagttttgttattgacagcgatgtgacgctttttagcaatatttttaatgataaattaaaacgaagtcaatattttttaattcaacgaaataaaagtcataataaagaatggattccgattgtgaaagataaccgcgttattgatattattattgatagtttggaattgcctagcttactgggtgtctctttttggtcaaatcatgatgcggtcaaaataaaatcatttctggctgattatgtgaataatgaaaatttattacttgattcatcattgtattgggataatattccaatggaaaatcttaaagaattggatattggtgtaaagcttttgaatataaaggaagcttatgaaatagataatttatccgagtatgaatttatatttcatcatttaaaaggtaaatagtatgaaaaaattatcgctgagagaacttcaattggtatcattagatattttgaaatattttgatcaattatgtgctaaaaatgatattcaatattccttaggcggaggaacattaatcggtgcagtaagacacaaaggatttattccatgggatgatgatattgatgtctatatgcagcgtgatcagtatgaaaaattcgttaatgtttggaaaagtgagacgcatgctcaatatgaattgtctttagcggaggatattcatggtatgtttccgggtgagatgacaaaaatttttgataaaaatactttaatcatagatacgaaaggaagaaaaagtggcatatttatagatatttttatttatgatggtgtgccaaatgacccggcggtgatttataaagtgatgaagaaacatcgtcgccttaaattgaggttttcatcttgtcgtaagagatggtataaagctaataatgagagtttaattcagtctatattttttagattatcccagtatttatttaataagatgatgttaaatttaaaacaatttcaagacaaatatcctattgataaggctgaatatataggacttgttttatcagattacggtggctagaagaagtcttatatgcccaaaaaatattttaactccgttgtttatttggattttgaagagagtaagtttcctgttatgaacggttatcatgaacatttgaccatgtattatggtgattatatggaactgcctcctgttagtgaacagaaacctcaacacacgattgaagcttatatattagattaggcaatctatttcttttttattaaaaatcagcaaaagagcggtcattttgctgatttttttttgatttatcggcataataggtgctataaaaattttatgggagtcattatgtgtaggggaaatttatatattatttctgccccaagtggagcagggaaatcttctttgatttcagcattattggaacgggataaaaacgatagtatgacggtgtccatatcacatacaacaagatccccaagaccgggtgaaattgatggggtgcattatcactttgtttcacatgaaaaatttgaacagcttattttagaaaactcatttttagaatatgcgaaagtattcggtgggaattattatggtacgtcattactgaatattgagaaaaatttagcggcaggtatagatgtattcttggatattgattggcagggagcaagacaaattcgagaaaaacgtcctgatgttaaaagtatttttattttgcctccttctatttctgccttagagaagcgtttgattgggcgtggtcaagatagtcaagacattattgcaaagagaatggaaaaggcagcggatgaaatctcccattatgatgaatatgattatgtcattattaatgctgattttgatcaagcattagtagatttagaacatattttgcgagctgaacgattgactgtaaattatcaaaaaacgcaaaatgcggctttaattcatcaattactagtaaaataattttggttttagtatcatgagagcgttttttgtgaatatattaatggagaaattatggctcgagtaacagtacaagatgcggtagaaaaagtaggtaatcgttttgatttaattttaactgcggctcgccgtgcgagagaattgcaattacataagcgtgaacctttagtgccggaagataatgataaaccgacagtcattgcgttgcgtgaaattgagaaaggattaattaataacgatattatgaacgctcatgagcgtcgtgaggcattagaacaagaaactgctgaattgaatacaatatcgctgttatatcaaaataattaagtaaagtgcagttcttttttgtaaactttatcaagtacatttcaatcttttttgcatattaatcaatagtcaggtgtcttttgtatttatttgagagtttagagaaaattatcagaggatatttgtctccgtcacaaattgagttagttcggcatgcttttgttattgcaagagatgctcacgaaggacaagcgagggctagtggcgaaccttatattactcatccggttgccgttgcttctattattgcagaaatgcatttggatcatgaagcagtggttgcagcgttattgcatgatgtaattgaggatacgccttatactgaagagcaattaaaagaagagtttggtgcgagtgttgctgaaattgtggagggggtttcgaaattagataaattgaaatttcgtacacgtaaagaagcggaagtagagaattttcgcaaaatgattttggcaatgacaaaggatattcgtgtcgtgttgattaagctagctgaccgtactcataatatgcgtacactgggtgctttaagaccggagaaacgccgtcggattgcgaaagaaaccctagaaatttatgctcctttagctcatcgtttagggatagagcacattaaaaatgaattagaagatttaggttttgaagcaatgtaccctcaacgttatgcggtattacgaaaagtgattcaaattgctcgtggtaatcgtaaggatatgattgagtgtatcgcttcagatattaaaggacgcttgacggaggtaggcattacggcacgagtatttggtcgtgaaaaacatctttatgctatttaccaaaaaatgcgattgaaagatcagcagtttcattccattatggatatttatgcttttcggacggtggtaaaggatgtggatacttgctatcgagtgcttggtcaaatgcacagtttgtataagccgcgtcagggacgggtgaaagactatattgctgtacctaaagccaatggttatcaatctttgcatacatctatgattggaccacacggtgtacctgttgaagtgcaaattcgtacggaagaaatggatcgaatggcggaaatgggtgtggtagcacattgggcatataagcaatcaggacgaaatgacagtacaacggcacaaattcgagctcagcgttggttgcgaagtcttgtggaattacagcaaagtgttggtaattcttttgagtttattgaaagcgtaaaatcagagttctttcctaaagaaatctatgtatttacccctaaaggacgtattattgagttgcctaaaggtgcaactgcggtcgattttgcttatgcggtacatacagatgttggacatcattgcgtggcagctactgttgatcgtaaaccttatccgctttcctttgcattacaatcaggtcaaatgattgatattagtatcgatggaaattcaaaaccaaattcggggtggctaaattttgttgtgacagcgaaagctcgcacaagtattcgccaagcattgaaatcgttaggtgccgatgatgctgttaatttaggcaaacgccaattactgcaggcacttttacctaaaaaacttagtgatattccaccgcacattgtgcaagaagttttagatgatttgaaattaacgagttttaatgacttgctgatggaaattggtttaggaaatcagattagtggagcaattgcttatcgattggtgggtgagccattgaaaattgatacggatggtaatcctaaaaataatacggaattattgcaaattaagagttctgaaggtttatcaacaacctttgggcaatgttgtcatcctattccgggagatccaattgtggcttatacgagttcaggaaaagggcttgttattcatcataaggattgtgctaatttgaaaaaacgtaaagagaatactgaacattatatgcaggtacaatgggaggatgaagatacctcgattgagtttgaaactgagttgcgtattgaattactaaaccaacagggtgctttacctcatttaatgtcaatgatttcttctttggatagtcgcattcatagcatttggacggaagagcaagacggtcgcctttaccaaattgttattttattaaccgtgaagaacacagaacatttggagcaaattatgcgtaagattaaaagtgttcctggctttttatctgtcaaacgcaacattaataattaatgggtggacaattcttagacgctattccacttacttctttgtcgggtgtcggtgccgcaatagcagaaaaattaggtagaattgggctttttagcctgcaagatcttctgtttcatttgcctattcgttatgaagatcgtacccgtattacccctattattgatcttcgtattgatcaacatgcgacaattgaaggaatagtacaaacttgtgatattcaatttggtcgtcgtccagttcttgtggtgacgctttctgacggtactgccaaaattgccttacgcttttttaattttaatgcaggtatgaaaaatggctttcagcttggagcgagggtgaaagcctttggggaaattaagcgaggtcgatttatggctgaaattcatcaccctgagtatgaaattattcgtgataatagacctcttcagttagcagaaacgctcaccccaatttatgcgacaacggaaggcttgaagcaaaatacattacgaaagttgactgagcaggcattagtgttgctagaaaaaatgccattagcggaattattgcctagagcttttaatccccatgattttagtttaaaacaggccatttacgttttacatcgcccaccaccagatatttctttggaattgttggagcaaggaaaacaccctgcacagttacgtttaatttttgaagaattattagcacataatcttgctatgcaaaaagtgcggtgcggatctcaacatttttcagctttacccttacgttatcaaacagcattgaagcaaaattttcttgatttattgccatatcaaccgacaaatgcacaacaaagagttgttgctgaaattgaatatgatctgggacgttctttcccaatgatgcgtttggtacaaggcgatgttggctccggtaaaactttagttgttgctttagctgcattaattgctattgataacggtaaacaggtagcactcatggcaccgactgaaattttggcagagcaacatactgcaaatttccaacattggtttgaaccgttaggaataaaagtgggttgtttgacaggaaaagtaaaaggcaaatctcgtcaagctacattggaggagatatcccaaggtagtatacaaatggttgttggtactcatgctttgtttcaagatgatgtcaagtttgccgaactggtattagttgttattgatgaacaacatcgctttggtgtacatcaacgcctgatgttgcgtgaaaaaggaaagtatgccggtatttatccacatcaattaattatgactgcaacacctattcctcgtacattggcgatggtagcctatgcagatttagatatttcaattattgatgagttacctccgggaagaacaccaattcaaactattgcggtatctgaagaacgcagaaccgaaatcgtcgctagggtgtataatgcttgtgttaatgaaaaacgccaagcgtattgggtttgtactttgattgatgaaagtgaagtattagaagcccaagcagcagaaagtattgcagaggatctacaaaaagccttgccggtactacggattggtttgatacatggcagaatgaaagtgagtgaaaagcaagaagtaatgaggcaatttaaaaatgctgaattgaatttgttggtcgctacaacagttattgaagtcggggttgatgtacctaatgcgagtttaatgattattgaaaatgcggaacgattaggtttggcacaattacatcaattgcgtggtcgggttgggcgtggtagtacggcatcctattgtgttttaatgtataaatcacctttgagtaaagtgtcgagaaaacgtttagaagtaatgcgttcaagtcaagatggcttctttatttctgagcaagatttagaaattcgtggaccgggagaagttttaggtaccaaacagacgggtgttgcagagtttaaagtggctgatttaatacgagatcgtaaaatgctgcctactgttcaacattatgcccgtctattaattacacgatctccaaagttagcagatgacctcattcagcgttggcttaaaaataaagaaatttataccaatgcgtaagtgaacatttaacttttgtggaactgagaattatataagtaaagagcggtcaatttttaggaaaattttatgaggttctcaatacaaccaacaattttattttttgattcaggtgtaggtgggttgagtgtttataaagaaactaaacaacttttaccggattgtcattatttatatggttttgataacggattttttccttattcagaaaaggacgaaaaagatattattgaccgcactttaagaatttgtcagaaaatcaatcaaacttatcccttagatttaattgtaattgcttgtaatacggcaagtacggttgttttgcctgaattacgccggaatttttctattcccatcgtgggaaccgtacctgcgatcaagcctgctgcagaaatgtcagaaacaaaacatattggtttgattgcgacgaaaggaactataaaaagaacttatgttaatgatttgattgaaaattatgcacatcattgcatggtggaaaaaattggtagcactaagttggtagagattgcagagcaaaaattacgaggcggtgaagttgatcttaatgtcctaaaacaagaacttagtccatggaaaactatgaaatcacttgattctgttgtattggggtgtacgcattttcctctaatcaaagaggaaatagaatgctgtttaccgcaggtaaaattttttgtgagttctggtaaggcaattgcgaaacgggttaaatttttattaaaaggtatagaagtgcggtcaaaaattcagaaaaaaaatttgattttttgtactaaacctcttgaagatgataagtctgttcaacaaattttagattttgggaaatttgagaatttagtgatattgtctgattgagactaagcaactagataaaaataaaacttgtattttgtaattgaatagattttcactcagataaatgtaggaaaattgagcaaacagtttttattttagacaaaggagagtatttttaaaaaaaattataaaaaaagcttgcattgaactataaaatgcctataatgcacggcacacaacgacacgctgttgtgagaggttaagcagtgtgtcgttattttttgttctttaacaaactatcagacaaactgtgtgggcacttgtgagactgtattaataagagattaaaagagtaagataagtgcttaaactagagaaattcatagagaaaagatggataaaatagtcagtatttattgagcgaagagattaaattgaagagtttgatcatggctcagattgaacgctggcggcaggcttaacacatgcaagtcgaacggtaacggggagggagattactttctctgctgacgagtggcggacgggtgagtaaagcttgggaatctggcgaatggagggggatagccacgggaaactgtgggtaataccgcgtaatgtctaaggaccaaaggggtgggactgtgaggccacctgccatttgatgagcccaagtgggattaggtagttggtgaggtaagggctcaccaagctgacgatctctagctggtctgagaggatggccagccacactggaactgagacacggtccagactcctacgggaggcagcagtggggaatattgcgcaatggggggaaccctgacgcagccatgccgcgtgaatgaagaaggccttcgggttgtaaagttctttcggtgatgaggaaggcgattagtttaagagattaattgattgacgataatcacagaagaagcaccggctaactccgtgccagcagccgcggtaatacggagggtgcgagcgttaatcggaatgactgggcgtaaagggcacgcaggtggtgacttaagtgaggtgtgaaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtgagacagttcggtccctatctgccgtgggcgttggagaattgaggggggctgctcctagtacgagaggaccggagtggacgcatcactggtgtaccagttgtttcgccagaagcattgctgggtagctaaatgcgggagagataagtgctgaaagcatctaagcacgaaacttgccttaagatgagttctccctaacgaagagttagtaagggatgtttgagactaagacgtagataggtggggtgtgtaagtgtagtgatatattgagctaacccatactaatttcccgaggggcttaaccatacaatcttgagtgttttgcatagaggaagaagcgggacaggatagagagaggaatacttgaagtagaggcttgtttttttattgaagaagagatagagacgggatataagagagaggaatttaacttggcggcgatagtgcggtgggaccacctgacaccatgccgaactcagaagtgaaacgctgtaacgccgatggtagtgtggggattccccatgtgagagtagggcaccgccaagttttttatgagtttattttgttagtttatttatattagtaaactaacaaaataaattttggcagtcatagtgcaatggaaccacctaactccttgccgaacttagaagtgaaacgttgttacgccgatggtagtgtggggattccccatgtgagagtaggtcactgccaaatatcaaatttagcggagtggtagttcagctggttagaatacctgcctgtcacgcagggggtcgcgggttcgagtcccgtccattccgccaatttatatctgtttaggggcgtagttcaattggtagagcaccggtctccaaaaccgggtgttgggagttcgatcctctccgcccctgccatgttttccttagtcatatatttcattaaaatttttcatctcatatcttttcatagtttcaaaaatgcaatattctattacaagacgaagaatatgcagcagttaatagaaattttggtggcattttcttatcaaaaaactcagtaaaatctatgtggagacaattgtgggaaataaaatcttaaaagggatttttttgctctatccgccgctgcgttgaatagtagtattggaatttttagcaaaaatttattagagcagaacctaaatattcaatctattgccttttttaaaacaattatcgcttttgctatgatcagtctggtgttaagtcgctcatcatggcaagaacagaaaaatcaagtaaaaccttttgcaaaaaatacagtgaacctacttttccaaatagctatttgcgcatttctggggattttaccttatttttctttgaaaccactgcttatcagtatggccatgccgctaatgtggtagtcgtactaatgaccactgctgccgtatcctccctgctcgtagggctatattattgtcagagccattgaaggtttccgccattgctggcacttgttttgccgtatttggcgtatttatcatttcttggtcgggctctagtcaatggctatctattctatatgccattcttgcaggtagtggctacggtttattttccgtactcatcaaaaaatttaatttaaatggtggcataccattaacacgattattgatgatgtttggagcgctatatttgttctatccatttgtcacacattttcaacatatagaaatccagtggaatacgactgttatactcaatcttgttgcacttgctttactacccacgctgattggtttttactgcacaaccaaggcgttagtttatctcagtgcatcgaaagtacaggtaactgaactgtcagaacctatcttcactatggtactggcatggttactactcaatgaagttccaaatcaaactttctttttaggtgcgttttgtattgtgttaggcattgcgttgatcaatcaaatgttgcaattcaaaaagtgagaagtgagttctaacaggttatgtacgctatgtgtagggtattttgatgggtatgagttttatatttaatcgatacgatttttaggcgagctgaaaactcatttttatacttacttacttcctttcttttctacaaatttaattattttttgtattatttaaataaattaattgagtgatttcaaaaaataagtatgatagccggagttttttgtttatctcttttagggagcttttatgctttatttggaatttttatttttacttttaatgctttatgtaggaagtcgctatggcggtattggattaggtgttgtatccggtattggcttagctatagaggtctttatcttccgtatgccagtaggtaaggcaccaattgatgttatgctaattatccttgctgttgtgacttgtgcatcggtacttgaggctgcgggcggtttgaaatttatgctacaaatggctgaacgtgtattacgtagcaatcctaagcgtgtaactatccttggacctttagtaacatattttatgacatttatgctcggtacagggcattctgtttactctattatgccaattattggtgatgtagcactaaaaaataatattcgtccggaacgacctatggctgcagcatctgttgcatctcaacttgcaattacatctagtccattatcagcggctgttgttttttatcttgggaaaatcaccgcacttccaggatttgagcatattaccttattagatattatttgtgttactgtacctgcgacattggcaggaactattgcattgtcactttatagtttacgccgtggtaaagagcttgaagatgacaaggaatatcaacgtcgtttacaggatcctatttggcgtgagcgtattttaaatacaactagtacaactttaaatgaagtattaccgccagcagctaagcagtcggtatatttatttttactctcgttagttgtgattgtaatgatcgcaatgtttcctgaaattcgtactatcggtagtgcttctaaacctatttcaatgtcattaattattcaaatgatgatgctatgttttggcggtattaccttgttggttacaaaaactaatccacaaattgtaccgaacggtgttgtatttaaatcaggaatggttgcagcaattgctatttttggtattgcctggatgagtgacacttattttcagtatgcaatgccacaatttaaggcaggtattgtagatatggtgaaagcctatccatggacttttgctttggcactatttgctgtttcagttgttattaatagccaagcagcaacagcggttatgatgttacctgttggaattgaattaggtttatctccagcattattagttggtctgatggcggcaacatatgcttatttctttattcctaattatccatcagatattgcaacggtgaactttgatgtgacaggtacaacgaaaattggtaaatattactttaaccatagctttatggctccaggtttaataggcgtttttacggcttgtgtggttggctacctcattgcacaagttgttattcgttaagttcatcaaataaaaagtgcggtttaaaaccgcactcataccgttaacagtttgatacgagagatattccgtaaaaagcaacatcactcagcattgtgaggtaacttttttgctttggttgtttgctaatttgtacttcacgtaattctttgacatgggcatagagatgtttttagaataaaacctcattcaatcgtcaaatgtatcttgctaaaaactatttggaatgatagaatctcaagccattttagtaaattgctgatagttttatactctcagcaatttacattttttaaatacaccgtttgattgcaaaagagttaggctaaatcaaactattagcttaatgcaatccgcacatcagaagtaaggttcagagggcggtacctagcaaacgggttcaagcattgatataaaatttattataaaatcgaccgcactttatgttgtcgaactgaattttatattgaatcggtctcactaatatttacagaggaacccaaatggtttactcctataccgaaaaaaagcgtattcgtaaaagcttcggcaaacgtccgcaagttttaaatgtaccttatttattaacaattcaacttgactcttttgataaatttatccaaagagatcctgacggtcaacaaggtttagaagctgcattccgttctatatttcctattgtcagtaacaatggtaatacagaattgcagtatgtcagttatcaattaggagaacctgtttttgatgtaagagaatgtcaaattcgaggtactacttatgctgcatcattacgtgtaaaattacgccttgttagctacgataaagatgcggcatccggcacgataaaagacataaaagaacaagaagtttatatgggagaaatcccattgatgaccagtaatggtacttttgtcatcaatggtactgagcgtgttgttgtatcacaattacatcggagtccaggtgtattttttgatagtgacaaaggaaaaacccattcatcaggcaaagtactttataatgcacgaattattccttatcgtggttcatggttggattttgaatttgatccgaaagataatttatatgctcgtattgaccgtcgtcgtaaattaccggctactattattttacgtgcattaaattacactaccgaagaaattttggatttattctttgataaggtttcgtttgagatcaaagataataaattactaatgactttagttcctgaaagattgcgaggtgaaaccgcatcttttgatattgaagcgaatggtaaagtgtatattgagcgtggtcgccgtattaccgctcgtcatattaaagcattagaaaaagataagattacacaagttgaagtaccgacagaatatatcgtaggtaaagtttcagctaaagattatgttgatttaacaacaggtgagattatttgtccggcaaatatggaaatttcgttagaattgttagagaaattatcacaagccggttataaaaacattgaaacgttatttaccaacgacctagattttggtccgtacatatctgaaacattacgtgttgatccatcctatgatcgtctaagtgcattagttgaaatttatcgtatgatgcgtccgggggagccaccaacaaaagaggcggcagaaggtttatttgataacttatttttctcttccgaacgttatgatttgtcagctgtaggtcgcatgaaattcaaccgctctttgggcattgaagacactacaggtagcggtacattgagcaaagaagatattgttaatgtaatgcgtaaattgattgacattcgtaatgggcgtggtgaagtagatgatattgaccacttaggtaatcgtcgtattcgttcagtgggtgaaatggctgaaaatcaattccgcattggtttagtccgtgtagaaagagcggtaaaagaacgtctttctttgggcgatttagagtcggttacaccacaagatttaattaatgctaaacctatttcagcagcagtaaaagagttctttggctcttcacaactttctcaattcatggatcaaaataatccgttatcagaagttactcataaacgtcgtatttctgcattaggtccgggtggtttaacacgtgaacgtgccggctttgaggttcgagatgttcatgcaacgcattatggtcgagtttgtccaattgaaacccctgagggaccaaacattggtttgattaactcgctatctgtttatgcacgtactaatgattatggtttcttagaaacaccatatcgcaaagtggtaaacggtcaagtcacagaagaaattgaatatttatctgcgattgaagaaggaaaatatgttattgctcaggcaaactcaaaccttgacaatgagcttcgttttactgatgctttcgtaacctgtcgtggggagcatggtgaatctgggttataccgaccggaagaaattcattatatggatgtttctactcaacaagtagtgtctgttgcagcagcattaattccttttcttgaacatgacgatgcaaaccgtgcattaatgggtgcaaacatgcaacgtcaagcagttccaaccttacgtgctgataaaccgttggtgggaacaggaatggaaaaacctgtagcactagactccggtgtagcggtggtggcaaaacgtggaggtactatccaatatgttgatgcttctcgtattgttgtaaaagtcaatgaagatgaaactattgcgggtgaagcggggattgatatttacaacttaattaaatatacccgttcaaaccagaatacttgtattaaccaaattccttgtgtgcaattgggagaaccgattgaacgtggtgaaatcttagctgatggaccatcaacggatctcggagaacttgcactcggtcaaaatatgcgtgtcgcattcatgccttggaatggttataactttgaagactcaatgttagtgtctgagcgtgtggtacaggaagatcgtttcactactattcatattcaagaattatcttgtgtggcacgagatactaaattaggttctgaagaaattaccgccgatattccaaatgtaggtgaagctgcgttaagtaaacttgatgaatcagggattgtttacatcggtgctgaggttaaaggtggagatattcttgtcggtaaagtaacacctaaaggcgaaacccaattaactccggaagaaaaactgctacgtgctatttttggtgaaaaagcatctgatgttaaagactcttccttgcgtgtacctaacggcacatcaggtacagtcattgatgttcaagtcttcactcgtgatggtgttgaaaaagataaacgtgcattagaaattgaagaaatgcaattaaaacaggctaaaaaagatcttgtagaggaattagagattttagaagccggtttgtttgctcgagtacgtaatttacttctttccggtggtttcaatgataaacaattggaaaacttagaccgcacccaatggttagagcagactttagttgatgaagataaacaaaatcaattagagcaacttgctgaacaatacgaagagttacgtaaagatttcgaacataaacttgaaattaagcgtagtaaaattatccaaggtgatgatttagccccgggagtattgaaagttgtcaaagtttatcttgcagtaaaacgtcaaattcaaccaggtgataaaatggcgggtcgtcatggtaacaaaggggttatctcgaaaattaaccctgttgaagatatgccatacgatgaaaacggtcaacctgttgatattgtcttgaacccgttaggggtaccatcccgtatgaatatcggtcagattttagaaactcatttgggactggcagctaaaggcattggtgatcaaatcaacgcaatgataaaacaaaaacaagatgttgaaaaattacgtggctatatccaaaaagcttatgatttaggagatggttcacaaaaagttgatctttcgacctttaccgacgaagaagtattgcgtttagcaaaaaacttgcgtaaaggtatgccattagcaacgccggtatttgacggtgcgcatgagaaagaaatcaaagcgttattagaattaggtgggttaccaacttccggtcaaattaccctgtttgatggtcgtacaggtgaaaaatttgaacgtcctgtaacggtaggttatatgtatatgctgaaattgaaccatttagttgatgataaaatgcatgctcgttcaacaggttcatatagtcttgttactcagcagccacttggtggtaaagcacagtttggtggtcaacgtttcggtgagatggaagtatgggcactggaagcatatggtgcggcctatacattacaagaaatgttaacagtgaaatccgatgatgtgaatggtcgtacgaagatgtataaaaacatcgttggaggcacacaccaaatggatccaggtacgccagaatctttcaatgtaatcatgaaggaaattcgttcattaggtatcaacattgatcttgatgaagagtaatgggtaaccacaaaaatacgcccaagtgtggtgggatttataaaagttttaaccgcacttgaataattttaactccgataggagcaaatcgtgaaagacttagttaagtttttaaaagcacaatcaaaaacctctgaagattttgatgttattaaaattggtttagcatcaccggatatgatccgttcttggtcatatggtgaggttaagaagcctgaaacaattaactaccgtacattcaaacctgagcgtgacggtcttttctgtgcccgtatttttggaccggtaaaagattatgagtgtctatgcggaaaatacaagcgtttgaaacaccgtggagtgatttgtgaaaaatgcggtgttgaagtaacacaagccaaagtacgccgtgaacgcatggggcatattgagcttgcctcacctgttgcacatatttggttcttaaaatcattaccgtcccgtattggtttattgttggatatgccactacgtgatattgagcgtgtactttattttgaatcttacattgttattgaaccgggaatgactgatcttgagagaggtcaattattaacggaagaacaattcttagacgcagaagatcgttggcaggatgagtttgatgcaaaaatgggtgcagaagcaattcaagccttgttacgtgatatggatttagaagttgaatgtgaaacattacgtgaagaattgcaatcaacgaattctgaaactaaacgtaagaaaattacaaaacgtttgaaattgttagaatcttttatccagtcaggcaataagccggagtggatggtgatgacagtattacctgttttaccaccggatctacgcccattagtacctcttgacggagggcgttttgcaacatccgatttgaatgatttatatcgtcgtgtaatcaatcgtaacaaccgtttaaaacgcctattagatttaattgcaccggatattatcgttcgtaacgaaaaacgtatgttacaagagtcagttgatgcgttattagataatggtcgtcgtggtcgtgcaatcaccggttcaaatcgtcgtccgctaaaatctcttgcggatatgattaaaggtaagcaaggtcgtttccgtcagaatttattagggaaacgtgttgattactcaggtcgttccgtcattacagttggtccatacttgcacttacatcaatgcggattgccgaaaaaaatggcattggaattattccgtccatttatctacgctaaattagaaagtcgtggctttgcaacgactattaaagctgcgaaaaaaatggttgagcgtgaagatgcgattgtttgggatattcttgccgatgttattcgtgaacacccaattttgctcaaccgtgcaccaacattacaccgtttaggtatccaagcatttgagccaattcttattgagggaaaagctattcagttgcacccgctggtttgtgcggcatttaatgctgacttcgatggtgaccaaatggctgtacacgttccattgacattagaagctcaattggaagctcgtgcattgatgatgtccacaaacaacattttatctccagcgaatggtgagccgattattgttccttcacaagacgttgtattaggtctttactatatgacacgtgataaagtcaacggtaaaggcgagggaatgttattacaagattcacgtgaagcagaaaaagcctatcgtacaggtcaagctgaattgcattctcgtgtaaaagtgcgtattactgaatatgttaaaaatgcaattggtgaatttgaacctcaaacacatttagtcgatactacaattggtcgtgcaattttatggatgattgcaccaaaaggcatgccatttagtttattcaaccaaactttaggtaaaaaagcgatttctaaattaatcaacgaaagttatcgtcgtctagggttgaaagagagcgtattgtttgctgaccatattatgtataccggttttgcttatgctgcacgttccggttcatctgttggtattgatgacatggttattcctcagaaaaaatatgaaattatttctgctgcggaagaagaggttgctgaaattcaagaacaattccaatccggtcttgtaacagctggtgaacgctataacaaagtaattgatatttgggctgcggcaaacgaacgtgttgctaaagcgatgatggaaaatctttcgcaagaagaagttatcaatcgtgaagggcagccggaaaaacaagcctcattcaatagcatctttatgatggcagattctggtgctcgtggttctgcggcacagattcgtcagttagcgggtatgcgtggtctaatggctcgtccggacggttcgatcattgaaacaccgattacagcaaatttccgtgagggtttaaatgtattacagtactttatttcaacccacggggcacgtaaaggtcttgcggatacagcattaaaaaccgctaactcaggttatctaacccgtcgtttagttgatgttgcacaggacttagtgattatcgaagatgactgtggtacacatgaaggaatcgtaatgactccacttatcgagggtggcgatgtaaaagaagcattacgtgatcgtgtattaggtcgtgtagcggcagaagatattttaaaaccaggcacaaacgaagtgttaatttctcgtaataccttattagatgaaaaactttgtgatgtcattgatgaaaattctgttgatagcatcaaagtgcggtctgttgtaacttgcgatactgattttggtgtgtgtgcaaaatgttacggacgtgatttagcacgtggacatttgattaatcaaggtgaagctgtcggtgttattgctgctcaatcaatcggtgaaccgggtacacagttaaccatgcgtacattccatatcggtggtgcggcatctgctgcggcaaaagaatctagtgttcaagttaaaaataccggtacattacgtttaacaaatgttaaattcgtaacgaataaagaagggaagttagttttaacttcacgtaacactgagttgacaattattgatacattcggaagaacaaaagagcattataaagtaccttatggtgcggtattaaattatgctgatggtgaagaagttacggcgggtgaaaccgtggctaattgggatcctcatacaatgcctgttatttctgaagtcagtggttttgtgaagtttgtggagattgttgatggactaacggtaactcgccaaaccgatgaattgacagggttatcttcaatcgtagttcaagatgtaggtgaacgtgcaacagcagggaaagatttacgtccggcattaaaactggttgacgctcaaggtaacgatatttttatcccaggcaccgatgttatggcacaatatttcttaccgggtaaagcaattgttaccttagatgatggtgcggaagtctttgttggtgaaccattggctcgtattccacaagagtctgtaggaacaaaagatattaccggtggtcttcctcgtgtagcagatttatttgaagcacgtaaaccaaaagaaccggcaattttagctgaaatttctggtatcgtgtctttcggtaaagaaaccaaaggtaaacgtcgtttgttaattacaccgatggaaggtgaaacatacgaagaaatgattccaaaatggcgtcaattgaacgtatttgaaggtgagttggtgcaacgtggtgatttaatttctgatggtgcggaaacaccacatgatattttacgtttacgtggtgtacatgccgtaacagattatatcgttaatgaagttcaagaagtttaccgcttacaaggggtaaaaattaacgataaacatattgaagttatcgtacgtcaaatgttacgcaaagcgattatcactaatgcttatgactctgaattcttagagggagagcaggtcgaagtcgctagagttaaaattgtcaaccgtaaacgtgccgaggaaggtaagccacttgtagaattcgaacgtgaattattagggattactaaagcgtcgttggcaacggaatcctttatttcagcggcttcgttccaagaaacaactcgtgttctaactgaagcggcagttgcaggtaaacgtgatgaattgcgtggcttaaaagaaaacgtgattgttggtcgcttaattcctgctggtacaggttttgcatatcaccaaaaccgccaaaaaaatcgattggtaggtggtatggaaaatacgactgaggttaaattatctgcagttgatgaggaagaaattgcttctgaatttaccttttcagcagaagatgcaacagcaaatttggcagagatgctaaatatggcagatgatgcagaataataagtagcttggtacaaaatatttaattttaaaaaccgatatttatgtttgtaaatatcggttttattgtttagataataaagtacatgcaacattattaaaaccgaaaatctgtgtcatattcaatgatcacgactattgttcaaaattttctgtaatatagaggaaacggataaacttcatttttaaaggatttgctgaaaggtattttgtatgaaaaaagctttcaacagtgtgaaatgcctgctataacttttgtaattttcgtttccgttttatacaatattcagcaacataaatgtcttcaagtaattaaccttaatagtggaacacctcatggaaaaaagcttatcccttattcctaatatcagaatgaaacgcgaaggaatgacaaatacggaaaaacgagtagttgactggttattagatgcaactaaatttaataaatccacagcattgaatgctattgcaaatgatcttgacgtatctgaggctttaattgtaaaagttgcaaaattactcggtttctccggttttcgtgatttaagaaaacaaatcactacttcttttgaagaaaatcaattagatacatttgaactttccagtcaagatacgcctcaagatcttgtagataaggtttttaatgtctctttacaaacaatctctgaaggcaaggcgattttaaattccaaagtcatttctgaagctgcaaaatgcttttttaatgctcaaaatagagatctgtatgctgctggtggttcaaatacaatctgcgatgatattgaacataaattcttgcgtatcggaattcgctgtaatacctatcgagatattcatttaatgatgatgtcagcctcattactcactgaaaatgatgtgatcttagtggtttctcattcgggtaaaacaaccgatttgttaaaagttgtctatgaagctaaaaaaaatggagcaaaaattatctgcatcacacatagtgatatttctcctattgctgttatttcggattttgtaatttgtacgcccgcaccagatactccattgctgggaaaaaatgcttcagcaagaattttacaacttattttagttgatgccttctttgtctctgtagctcaacaaaatattcacttatctgaaatgaacttagagaagacatttactgcaacaaaatacttcagaaaaaaatagcttccttccattaaaaaggtccttttttatcattaaaaactttacaatgttttaatatttgtgaagttgatcacttttttacccctttcaataaagtataattataaaaaaataaataaaaattataaaaatatgaagtttaatcattttttataatttttagttttctattaacttacataaggagtaatttcatgaaaaggttcaaaacattaaaatcctgtttggctatacttggcttagtttgctctgtttcggtttattctgctgaatatgccgtaatacttaaaacgctttcaaatcctttttgggtagcaatgaaagaagggattgaaaatgaggcaaaagcactgggagtagatgtagatatttttgcttcaccatctgaaggtgattatcaatcacaacttcaattatttgaagatttaatcaataagaattataaaggtatcgcttttgctccactttctcctgcaaatcttgttatgcctgctgccaaagcctatcggaaaggtatttatcttgtgaatttagatgaaaaaatcgatattaaaaatttacaaaaggcaaaaggcaatgtagaggcatttatcacaacagataacgtagctgtaggtggaaaggctgctcaatttatagtagataaattaggttctgaaggaggcgaagttgccattattgaaggaaaagcaggcaatgcttcgggtgaagctcgtcgtcgtggagcaagagaagtttttgttaaaagttcgagcattaaattagttgctagtcaacctgcagattgggatcgtattaaagcactggatgtagcaaccaatgtactatcaagaaatccaaatctaaaagccttttatgtcgcaaatgatacgatggcaatgggggtagcacaagccgttattaatgctgggaaacaaggtaaaattttagttgtgggtaccgatggagttcctgaagcaagaaaaatggttagcgaaagaaaactcactgccactatcgctcaagatccggcaatgattggtgcaaaagggttgaaactgcttgttgatgcagcgagagcaggaaaacaaatacctgttgatgttgagccaaaaattgaaactgttgattcgatattaatttctcaataatacggaagtatgtggggattttaatctccacataggagtgtttttctatggcaatcccattaatacaaatgaaaaatatctcaaaaagttttggtgttgttcaggcattaaaaaatgtcaatcttgatatttatacgaatgaaattcacgcattactgggtgagaatggagcgggtaaatcaactttaatgaaagtcttatcaggattgcatatgccttcctctggttcaattatcattaaagataaagaatatgatcatttagatcacaaaatcgcaacagaacttggaattgggattatttatcaagaattaagtttaattgatgaattaagcgtacttgaaaatctttatatcggtcgtttaccaacaaaaaaattttggggtattcccattgttgattggtcaaaaatgcgttctcaagcgtctattattttattaagactaggaattaaagttgacttagatgagaaagtaggaaatttatctatttcttacaagcaaatgattgaaattgctaaagttcttatttcagatgtaaaaatcatcattatggatgaacctacctcatcattgactaactcagaaattgattacttatttttcattatgaatcaattacgtaatgatggaaaagcgattatctacatttctcataaaatgaatgaaattcgccaaatttgtgaccgttatacaattcttaaggacggaagtagtgtggcttccggtatgataaaagaaatcagtaatcaagagattatccgcttgatggtaggacgtgatatagaatctcggtttatcagcagacaacatactgtgagtaatgaggttatttttgaagttaaaaatcttacaggtaaaaaatttaaacaagtcaataatgtttcattttccttaaaaaaaggggagattttaggctttgccggtttagttggtgcaggtcgtacggagttgatgaactgtatctttggcattgataaacgcatttctggggaaatttatttaaacggtaaaaagattacaccgtcatcaccattagaagcagtgaaaaaaggtatggcgtatatcacagaaagcaggcgtgagaatggctttttttccaatttttctatcaagcaaaatattgctgtttcaaaaagtttaaaagatggtggttataaaggtgcggtgggaattttttctccttcaaaggaagccaaacttgcacaacagcaacaagatcttttatccataaaatgtgcgtccattgagcaaaatattacggagctgtcaggtggtaaccaacaaaaagttattatcggaaaatggattgtttgtgatcctgaagtattaatttttgatgaaccgactagaggtattgatataggggcaaaaacagaaatttataaaattatgcgtaaattagcagaacagggaaaagctattttgatggtctcttccgaacttcccgaaattatgtctgtatgtgatcgcattgtggtattccgagaaggagctatttcctctattttagagaatactaaagcgttaacagaagaaactattatgcgttgggctttaccagagacaaaagaggtaaattaatgatgaatacaggtaaatttaatttttcgcaattttgggataaatacggcacattctttattcttgctgttattgtccttatctttggatctatatccagccaatattttttgaaagccagtaatattcagcaaatttttgttcaaagctcggtaacagtcctaattggaatgggggaatttttcgctatattgatagctggtattgatttgtctgttggtgctattttagctctttcggggatggtgacagcacagttaatgattatagggatagatcctcttgttgcctctattattggtggcattctagtgggaggtggacttggtgctattaatggtgcgttagtcaattacacaggcttacatccttttattattacattaggcacaaatgccatttttagaggtattacactcgtcatttcagatgcaaattcgatttacggcttttcttttgagtttgttgatttttttgctcaggatattttcttcattcctgtaccggttatattcgttgtggttattgctattctactttggttcgttacaactaaaacacgattaggtcgtaatatctatgcgttaggtggaaataaagaatcagcatattattccggaattgatgtcaagtttcacactatggcggtctttattatttcaggtatctgtgccggtcttgccggtgttgtttctacggctcgattaggtgcagcagagccgttggcgggggttggttttgaaacttatgcgatagcaagtgcgattatcggcggaaccagttttttcggaggaaaaggacgtatttttgctgtcgttattggtggcttaattatcggtacgatcaataacggactaaatattttacaagttcaaacttactatcaacttgtggttatgggtggtttaatcatcatcgctgtcgcattggatagattaattagtcgttaattttttgaggtaacatcatgaaagtttttatttcaccatcactcatgtgcatggatcttactaaattcaaagaacagattgaatttttggatcaaaaagtagcttattttcatattgatattatggacggtcattatgtacctaacttaactctttcaccattttttgtcagtcaagttaaaaaactcgctacgaaaccattggattgccatcttatggtaactaacccagaaaattatattgatgatttggctaaagctggttgcgacatgatcactttgcatgtagaaaccatttcaggacaagcatttagacttattgaaaagatccggtatttagaaatgaaagtcggcatcatttttaatcctgaaacgccaattgaaaaagcaaaatattatttatctaaagccgataaagttacgatattgacggtcgatcctggatttgcaggtcaatcatttattcctgaaatgttagaaaaagtggcggaacttaaattattccgagaaactcatcaattaaattatgaaattgaaatcgatggctcctgcaacccgaagacttatgaaatgcttattaaggcaggtgcggatgtgcttatagtaggaagttcaggtcttttcaataattcagataatattgttgaggcttgggatatgcttgaaaaagagatagaaagaatattaagtaaaggaatgttgtaatgaagaaagtatttgttggtattgatatgggggcaacgcacattcgcatttgtgtgatggatgagcatcatcaaattctttctactgataaaaggaaaacattagaagtactcaaaaatcaaccgctctatggactaacaacattttgtaaagaatttacaactgactttattattcaacgaattgttataggacttcctgcagcagtttcattggatagaaaagaaattctttctgtacctaacttatctctttctaaacaagaactagacggatttgttccaatgttagagcaatattttcattgtgacgtacaattggaaagagatgttaatttacaattgatctacgatgttaatgattatcaacggaataataagttagtgataggtgtttatctaggcactgggatgggtttttcaatatggaaccaaggaaagctatttattggagggcatggtgtagcgggtgaacttggacacattccttacggtgatgaacatcttcaatgcgggtgtggcaatatgggatgtttggaaactaactgttcagggactgcactaagaaaatggtatgataaacaacaagcaaattatccattagagcaactttttgatagagcaattcaagagaaattcattcaaaattatcttatcaaagtcgctaaagcaattagtactgcggttaatttatttgatcctcatactttgattttgggcggtggcgtaattgacatgcaaaaattcccatttgaacaactaaaaatattgatcagaaaacacctgagaaaaccattaccttacaatgaattagaaatattaaaagctaaaccttcctctattaatggggcaataggcggtgctatttacgctataaataaggagaaatgatgaaaacaatcgctattggttcggatcatattggtttggcactcaaaacctttttaattgaaaaattagaaaaacagggacataacttactagacttaggtgctgtttcacaagaacgtacagattaccccatttacgctgaaaaagttgcttatgctgttaagcggaatgtagctgatgttggaattttaatctgtggaacaggagttggcatttctattgcagcaaataaaatctcaggcattcgatgcgcattatgttcagatgaacttaccgcactaatgtgtcgtgaacataacaactgcaatatcattgcatttggtgccaatattatatcttcagaaaaagcgatatccttagcaacactttggctgaatacgccctatgacggaggacgacatcaaaaacgccttgacatgatggaaatgcttgaaaaaacaggaagttattgcggattggttactgaaagataaaatctataaaataatataaatatttaagaatatttaaattatgctataaccacacctatgaataaacttttctctatcggacaagcaggtaaattgctaagcgtaactattcagacattgcaaaactgaggtagaaaagactgttacaagctgatgagctgaccaaaggttggtatcgcagatataaactggaaatgcttaaagcaattaatcacaatatcgtgcttaattgagatgatttaaaaaccattgcgtatgcaagagtaagtagatacactcagaaagaagattttgttcttatagatttgttttccttgtgaataatctaaccaaatattactcggatttaatttctttttgaaggcaaaaattttattacagcagatacatttaaaacgttttttggcggtgcaatttgttattagaaaggatttaaaatgttgcgggtatttgtgttggaatccccgccctttaggacggggaagtgttgagttttagttatagaataaagtggcttaaatcttcgttctctacgacatcacctaatgctccggtaacgtaatcaccgtcaattatgacgttttgaccgctcatttcactggcatcaaaagagatcttatccattaagcgttccataacagtatgtaaacggcgagctccgatgttctctgttttttcattgactctaaaggctgcttcagcgatttttttcaccgcactttcagtaaattcaatatcaaccccttcggttgccatcagtgcttgatattgttcggttagggacgcattaggttcagttaaaattcgttcaaaatccttggcagttagtgcggaaagttcgacacgaataggtaaacgcccttgtaattcgggaattaaatctgacgggcgagcgacttggaatgcccctgatgcaataaataaaatgtgatcggtttttaccataccgtgtttggtattgactgttgaaccttccactaatggcaatagatctcgttgtacgccttcacgagatacatcagcaccgctgtattcgccttttttgcagattttgtcaatttcgtcaataaagacaattccattttgctcaaccgcatcaatggctttttgttttaattcttcaggattaattagttttgccgcctcgtcatcaattaatgcttttaacgcatctttgattttcattttgcgttttttagtttgaccggaagataaattctggaacattgattgcaattgattggtcatttcttccataccgggaggtgccataatttcaacgccgatatttggtgcggcaatgtcaatttcaatttcacgatcgtccaattgcccctcacgtaatttcttgcgaaaaatttggcgtgtgttggtattggtatctcgttcttcaatttgtccccattgatctttcgctgggggtaatagggtatctaaaactcgctcttccgccatttcttcagcacgaaaacgatttttttcaatttctgtttggcgtacaagtttcatggcactatctgttaagtcacggataattgaatcaacttctttacccacatagcctacttccgtaaattttgttgcttcaactttgataaatggtgcattagctaatttagctagacggcgggcgatttctgttttacctacgccggtaggccctatcattaaaatattttttggggtgacttcatggcgtaacggttcttgtagttgcattctacgccagcgatttcttaaggcaatagcaaccgctcttttggcatcagcttgtccaatgatatgttgatctaattcagaaacaatttcacgaggggtcatttcagacataatatattccttgacaattattcggataattcttcgatagtgtgggttaaattggtgaatacacaaatgtcaccggcaatttttaatgatttttctacaatttcacgtgcggataaatccgtattttcgactaatgctcgtgctgcagataatgcataatttccgccagatccgatcgctaaaatttgatcttcttccggttgtaccacatcgccattaccggtaataattaacgattctgttttatcagcaacaataagcattgcttctaaacggcgtaatgctctgtctgtacgccattctttagccaattccaccgcactttttaacaaatgtccttggtgcatttccaatttacgctcaaaaagttcaaataacgtgaaggcatctgctgtaccaccggcaaatcctgttagaaccttaccgttgtatagacggcggactttacgtgcattgcctttcattactgtattgccgagtgatacttgtccatcaccgccaaccacgacttgccctttacggcgaacgctgacaattgtagtcatttttgattccttaactttcttttcttttatctgtcgctatatgaggattaactgtgacctttcaaggatatatacaaaataaaattttgatttttgtagagggatagaatttaacattcttatttgaagcactaaaggagcgattgcattgaaattgattggacaatcgccgagattatattaacaatctgtcggatcaagtcgctaaatacagaaaatctctttataatgaccgcacttttaccgcaagtgcggtttctttttactatttttaaaggaagataaaatgacggtattgaaaaatgatcgttacttgaaagcgttactacgtgaacctgtggatatgacgcccgtttggatgatgcgtcaagccggacgttatttaccggaatataaagcaactcgtgcaaaagcaggggattttatgtccctttgccgtaatgccgatttagcttgtgaagtgactttgcaacctttacgtcgctatgatctggatgctgctattttattttcggatattctgactatccctgatgctatggggctgggattgagttttggtgtgggcgaaggtcctaaatttgcacgaccaattgataacaaaagtgcggtacaaaatcttccgattcccgaccctgaacaagagttacagtatgtgatgaatgcggtacgtactattcgccgtgagttaaaaggtgaagttcctcttatcggtttttccggaagtccttggactttagcaacctacatggttgaaggcggaagcagtaaagcctttactaaaatcaaaaaaatgatgtattccgagccaaaaatattgcatctgttattggataagttagcagacgccgtgatactttatcttaatgcacaaattaacgctggtgtgcaggcggtgatggttttcgatacgtggggcggtgtattgggacatcgtgaatatttggatttctcattgcaatatatgcacaaaattgttgatggcttaattcgtgaaaatgacggatataaagtgccagttactttgtttacgaaaggtggtggtttgtggttagaggcaatggcaagtacgggatgtgatgcactaggtttagattggacggtaaatttagcagaggcaaaagcacgagttgggcataaagttgcgttacaaggaaatatggatccttccgtgttatatgcttcgcctgcacgaattgagcaggaagtacaacaaattcttgccgattttggacaaggtagcggacatgtgtttaacttaggacatggtattcatcaagatgttccggaaattagtccgaaggtttttgtggatgctgttcatcaatattcaatatcctatcatcaataaaagtgcggtgaaaataatgcgaaatcctattcataaacgcttagaaaaatttgaaagttggaaaaatatcacatttatgctgtgtttatgtgaacgtatgtaccccaatttttatttattttgtcaaatgacagagcaaatggataaagccaaaatatatcaaaatattttgaatttagtttgggaatatttaaccgttaaaaatgccaaaattaattttgaaaatcagttggaaaaattagaaaatattattcctgatgtgaataattatgaattttttggtgttgtaccggcattagatgcctgtgaaggcttatcggaattattgcatgcaattattgctggagaaacactggagaaagcaataaaaataagtcaattgtcgttgcaaacagtgataactttgctggaaactcagcaagacaaagcgttttctgaagccgagttgaagcaaagtgaagaaattgaattggaattggatgtacagtggcaaatttatcgtaccctaaatgcacatgaagaaagagatattagactgattttagatttaaaaaatgagttgagagagagcaggttgtctaatatcggtatagaaattgctcaataatgtgatttagttatcaatttttacagatattacttttttttctataaaacttagattatgcttgacactactgtagttacagtaattgttgccgctggaagatgagctatctttttcggcacttttaaaaaattttaatatgaagaaggtactaatttatgaataagacagacttaattgatgcgatcgcaggtgcagcagaattaaataaaaaacaagcaaaagcggcgttagaagcaaccttaggtgcaattgccggcagtttaaaagcaggtgaagctgtgcagttaatcggttttggtacatttaaagttaacgagcgtaaggctcgtaccggtcgtaacccacaaaccggtgcagaaatccaaattgcagcatcaaaagtaccagcatttgtagcaggtaaagcgttaaaagactcggtaaatagctaagttatttttctctatctactttaaacctcgcatttgcgaggttttttgttatcttattttttctctacctctacctctacctttctttctaaatcaaaacgtatttacaattctttttttttatgtaaaattcgaaacgaaatttaaattatggtttttttatgaaacgaaacttttatcctaggaatactgaacagcgtcgtcaagtgataatgcagttactgcaagacaagggagagattagtgttgagcagttagtgcagtattttaatacatctgaagtgactattcgcaaggatcttagtgcattagaaagtactggttttttattacgtaagtacggaggagcagttttaataccgcaagagctattggaagcaaatcacgaagaattactttctaatcgaaagttagctattgcaaaagcagctgcggaacgtattgctgataacaacagaattattatagatagcggtagtacaacagccgcacttattaagcaattaaataataaacaaggcttagttgttatgactaattctttgtctgttgcgaatcaattacgatctttggagcatgcacctacattattaatgaccggtggtacatgggataccggatctgaatcatttcaaggcaaagtagctgaacaagtattgtattcttataactttgatcaattatttattggtgcagatggtattgatttagctagaggaacgacaacgtttaatgaacttgttgggttaagtcaggtcatggcagaggttgctcaagaagttattgtgatggtggagtcacaaaaaattggtagaaaaatgcctaatttagaattaacttggcaacaaattgatgtgttgattactgatgagctgttgaatgatcaaattaaaaagcaaattgaattacttggcgtggaagttgtctgcgtaagtgcggtctaaatttttttattttaaggaaataattatgtgtggaattgttggtgctgtggcacaacgtgatgtggcaaagattttaattgatggattatatcgtttggaatatcgagggtatgattctgctggtgttgcaatattaaatgagcaacgtcatgtacaaattgtacgccgagtcggtaaggttcaggcattagatgacgcaattgaaaagcaacagttatccggaggaacgggaattgcacatacacgttgggcaacacatggggagccttcagaaattaatgctcacccacattgttcgggaaaaattattgttgtacataatgggattatcgaaaattaccaagaattacaagaagttttacaacaacgagggtacatttttcaatctcagacagatacggaagtgattgctcatttagtcgaatgggaattgcgtagtgcaaacactttactggaggcggtacaaaaagcgattgctcaattgcgaggcgcttatggaaccgttgtgatgaaccaagatgagccggagcatttgattgtggcccgttccggcagtccgttagtcattgggttaggtataggagaaaatttcttagcttcggatcctcttgcattattaaatgtaacacaccgttttatctatctcgaggagggtgatgttgcagaaattacatgtcatagcgtggatatttttgattttaatggtaagcaagtagagcgtgcaattcataagaataattttgagacagatgtaatagataagggaccttatcgtcactatatgcaaaaagaaatttttgagcaacctcaggcaattatgaatactctagacggacgtattttaaatggacgggttaatattgatgccattgcaccaagtgcggaggaaattttacggcaagtagaacatatccaaattgttgcttgtggtacttcttataatgcgggtatggttgcacgttattggtttgaatctattgcgagagtgagttgtgatgtggaaattgcatctgagtttcgctatcgcaagtctgtaactagaccaaatagcttatttattaccctttctcaatcgggcgaaacggctgatacattagccgcattgcgtttagcaaaacaatccggatatatgtcagtcatgactatttgcaatatagccagttcatcacttgttagagagtctgattttgcctttatgacacgtgcaggggttgaaattggagttgcttcgacaaaagcgtttacaacacaattaacctgtttactcttattaaatgtagcacttggtcgtattaaaggctctattaatgtagagcaagaacgtcatatcattcaatctttgcaacgtttacctgctcagattgagagtgcattggtttttgataaacaaattcaaaaattatcagaagattttgcagaaaagcaccatactttatttttaggacgaggtgagtattatccgatagcgatggaatctgcgttaaaattaaaagaaatttcttatattcatgcagaggcttatgcagcaggtgagctgaagcacggacctctagcattaattgatggcgacatgccggttattgttgttgcaccggaaaatgatttgctggaaaaggtgaaatctaatattgaagaagtgcgtgcacgtggcgggcgattatatatttttgctgatcatgagttcggttttggtaatagcgatagttttaaaacgttggtattgccaaaagttgatgctatcacagcaccaattttttatacggtacctttgcaattgttgtcttactatattgctttaattaaaggcactgatgtggatcaaccccgtaatttggcaaaagcagttacagttgaataaaaaatagtaaaagtgcggtaaaatttaccgcactttggttatttgattcaagttgctaccgtaaacagctattaccagccttttgcgacaccgtctttaaagtgcttataagcttcttgataaacttcctctgtttgataggcttttacaaagttttgtacttctacgctgtctttattatctttacgagcaacaataatattaacgtatggagaatctttgtcttcaacaaagataccatgttctgcactgtttaaaccgacttgacctgcgtaagtattattgacaacagctaaagctacatcatctaacgcacgagcggcaacagaagtatctacttctttaatctctaaatttttcggattttcgataatatccaatgcagtagagaataaatttgtattatcttttaatttaattaatccttgtttttctaataaaatcaacgcacgagccaaattgcttggatcgttaggtacggcaactgtatcaccgtctttcaattcgctgatattcttaatttttttagaatagccggcaagcggataaacaaaggtgttacctacaatttctaaattagtgatatttttagattgtgtatctttatctaaataaggtttatgttgcatcgcattaatgtctaaatcaccttttgataccgcagcgttaggtaacgcataatcattaaatacgacaaattccactgctaagttatatttttctttagcaatttgagctgccttttctgccacttgatgttcaggacctgccattacgccgactttaatttttgccggttcgttttggtttgctgctgtttctgtttttttatcatctttacaagctgttaatgcaacagttgaagcaatggcaatagttgcgaaaagtttgtttaatttcataagatttcctcttaaatagttgtgtttaaaataaattagcgatgatcaacttttttagctaaatcatcccctagtttttggctaataataacaaataacacgatgataatggttgaaatccaagtgatgaatcccatgccacgatgtactccgtagttaatagctaaacttcctaaaccacctccgccttgggttccagccattgcagtatagccaattagcgttacaaaagttaatgtaattccattgataagagagggtagagcctcaggtaaatagaattttgtaataatttgccaattggtagcccccaatgcttttgctgtttctgttagaccggttggaatttcaaataatgcattgctggttaagcgagcaaagaatggaattgcagcgacacttaaagaaacaatagcagcattggttcctaacgaagaaccaacaatatagcttgttacaggaattaagatcaataacaaaataatataagggacagatcgacctatattaataatgatattgaaaattttattagcattgctattttccagaatttgttttttgcccgttaaaaaggttacgcaaccaataggtaaaccgatgaggactgcgataaacgttgacacaatcgtcatataaacggtttcccaagtagaaagagcaattttgctccacatttccggcgttaattgttgattgaacgtaattagcagattatccaacatagcctaatacctccacacggacgttattttccattaaataaattttagtttgcgtgatggcttcttcctcaccttcaacttcggcaataacaaagccgaattttacctcaccggcgtaatctatttgtgaacttaaaatactgagatcgacgccaaattgtttagatgcttgagataataacggggcatcaacggagcgaccggtaaattcaaatttgataattgggtaagattttgcatgttttggcgttgccgataatttttccatatattcttccggtagattaatatggaaagttgaatgaataaactcttgagcaagaagggttttcggattagagaaaatatctccgacagaaccttgttcaattaattgccctttattaattaccgcaacttgatcgcaaatacgtttcaccacatccatttcgtgtgtaatcagtaaaatagtgatacctaaagtgcggttaatttcttttaataattttaaaatagattgtgttgtagccggatctaatgcactggttgcttcatcgcacagcaataccttaggactgtttgcaagtgcacgagcaatagcaacacgctgtttttgtccgccggataaatttgccggatagacatcttttttatcgtatagtcctactaaatttaaaagagcgtcaactttttgtttaatttgggttttatccgttttctctagttctagcggcagtgcaacgttatcaaagactgtgcgtgagcttaataaattaaagtgctgaaagatcataccaatatgacggcgagcatgaattaactcgttatctgaaagttgagttaaatctgtattatctacaatgacagagcctgaagttggacgctccaataaattgatgcagcgaataagagtactctttcctgctccggaggcaccaattactccacatatttgtccttgaggtacttcaagactgacattatcaagtgcggtcagatttttgcctgaaacattgaacactttactgatattttttagcttaatcatataagcccttttctatatagttaaattaaaattagcttgtattttagacgtctagattgctatgtcaatatttattgaatagatttttataaggatttatcagttattggcgatataataaagaaactttgtttttcatagaggtattatgtatatgaataaagcgatttttttagatcgagacggcacgttaaatatcgatcacggttatgtgcatgaaattgacaaattccagtttatagcaggaagcattgaagcattgaaacaacttaaatctatgggatttttattggttttagtcacaaatcagtctggcattgcaagggggtatttttctgaggaacaatttttacagctcactgaatggatggattggtctcttgcagacagaggcgttgatttagatggtatttactattgtcctcatcacttagaaggaatcggggagtataaacaagattgtgattgtcgtaagcctaaaaatggcatgctactgcaagcaataaaagaattaaacattgatcctgcaagatcttttatggtgggagataagaaagaagaccttttggcggggaaaagtgcggggataaaaaagaatattttggtcagaagcggtaaagaaatcaccgatgacggattgcctttggctgattatgtgttagatactattgctgatttacccgaattaataaaaaaattaaaattttaaccgcactttttattaaaaaattaggctatgtcttaaaataagattgaatgatgaaattcagttttttgcgttctgtttgcataattgctcattctgtacatacaaaaagagataacatttctgctatctctaatgcctacaatcatattttttagtttctacctacaacctgttttgttgcctctattttcttatctttccataaaacaacatcttttataacaagtttttggacagcagaaataagaagttccatataggaaaagtctatttcgttattttttgttgggagcataattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctaacgcttctttctcctcgctagacaattcataattgtctaatccgcttaccgttaggtaagcggagagttcgcttatacgctcctcttcgagttcgcttataaagctctccataaattcaaaatctattttgccgtctttagttggaagctggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttatatcaaacaaatctccaattctatactcgccccactgaacattttggagtttttcattcagtgaggcatttatttttttaggcgttcattctccttatctgtatttttaagaagagtggatacttcccaagcaaggtaatcggctacagttttcttaaaatcttcaagtgttggtcttgtatctatcggtgctgattgattccagtctgaaccatttaaagggtcaatatgaccttcgtaatattctttttctgtaaagatgtttaatttttgttttccaaaacgcacaaggtctaccacttcctgatatctttcttttgctctgtctgtatctctaagatttacacttgctttttttctgttcgttcttgtgtaaccatcatttgaaaaatcgataaacttaacgacttcatctctttgatgagattcgcctactctaaatacataaatatttgtttgaacacttgattttccaacaaataaatcgatgggcattttaatacttgcaagtagggtattgttttttagaatttttttgtttatttctgttgctttgccacttcctgcagagttttgaatgatgattgctgcatagcccttgttcatcatagatagggctttttctacgaaaatcattccattgccctctgctgaataaggcggatttaacacaaaagcagtagctggaaatttcgcatctgttttaccaaatccatatttaccgtcaaaatcatgtagtgagtctttgtttaaaatgtttgaggwtccatctcccataagtatcatatttaaaatggcaagcatatagatgttggatagaacttctaagcctaaaagctgttctgcttttatctttagttgtttttgctctagctcaagtggtgatgtgatttttgcttttgcatctataatcatctcgttcattgcagcaacaagtagccccgcacttcccgttgcaaaatcccacacatagctgtctttatcaactcttgcaagttttactaaaaaagttgctacataagatggggttaaaacaacatcgtttaatttgtcttgcgtaaagccgagccaagagtacatttcattaaagagcttacctgtaaagtctgtagttaagcctattttgtagtagatacctaggtcatcaacgattttagcaaatattctttttaattggctttctccgtttattggcttattaatattttctgatagtaatgtattttttagtgttcttacgataaggtcttgttttgtttttggtaggtttttcttttttaaaaacgcttctatttttctaacgataatttcgccgtctgtgtttccctcttctattgatgattttaggtcagacttttctagtggacttacccccccccggtattcctagtgttgccataatagaagctgacacaagatagactctgtcgttttcactaagccctttttcatttgcgtaaatatcattgtttagctttactaaacttgcatttatttctttttcacgtttttctttaagtgcttcaagttcttcagcagataaagaaagttcgtttacttttttaataaaatctgtaaagttttcttttcttaaaaatgaaaggtctgtgtattttcctacttcttgccctatcccaaaattatcttttgatacatagtaaacgccaatagagtgttctatttctccgttttcttttttatatcccgtaacaccgattgctattacatttgtgtagcttgtgtagtgaagtatggcattggcataatgaaccgctccatttacagcatagctattaatatttttgtaattaggctcgtttttacttgttctattgtcaactctaccgtcaatgtctaactttactaatttatctttatatcctttatattctatcagtattggataatagttaagtgcctcatcttgcaataaaagcttagcatccggtctatttccacccgttccgccactttttgatttatattcatcaagtgccttatctatttgtgcatttagactttcttgttctaatttataatctaacccataacttttaagccacccatttacaaggtcaactatgtttggttctatagattgcattttaaccattgtctattctcccttttcaacatattcatcatcaaaagaaaatccatcgttcggtgtgcagtcaaatgccttgaatattctctctaaatttttaagcgttatcggtttatttttcccatttttgccataatattggttgttaaatctgacattgttataacatcaattttccttaagcctgtcaatcgtattttagaatgcaaccaaaaattatcttaaaaacccttaataataagggtttttggtgagagagtttttaatgagaacgttgtactagcaagtgcattctagcgatattttgagcggtagattctagattttgtctgccttgagccaaaatttcaggcaaactgtctaattgacgaataatggggaatactgcatcaatgccatgctcatagactacttcataatcttcccgtaagcagcctgtaatggctataacaggtttatttgccagtttggcagtttttgctaccccaataggcgttttgccgtgaatagtttgtgaatccattctaccttctccggtaatgaccaaatcggcatccttgataatttctgctaaatttactgtatcaatgacaatctgcacaccggatttgagttgtacttgaggcaataatagcaatccaccacccataccgcctgcagcacccgatccgggacgctcagcaatccattttccgcaatctcgttctacaatacgactaaaatgcagtagagcttggtccaattgttgcaccatttccggtgttgctcctttttgtggcccgaaagtagcagaagcaccttttttaccacataaaggattatttacgtcgcaagctacattaaattgaacttgtgtcaaacgttgatctaaatgtgcagtgtcgatatgagcgatttgttgcagagctagaccgccaaagccgatttcttttccttgagcatctttgaatttgatacctaaggcttgtagcataccgacaccaccgtcattggttgcactgccaccgatacccaaaataatttggctcacccctagatccaaggcggcgttaattagttctcctgtaccatagcttgtggtgtagtaaggattgcgtttttctatcggcaccaaatgtaaaccggaagccgccgccatttcaataattgcgatttttccatcacccgatatggcaaattcagcttgcgttttattacctagaggtgcggtaacctctacagaaatcagtttgccttgtagtgcatcggcaagagattggactgtgccttctcctccatctgccatgggaacttttacataatctgcattggggtagatttttttgaaaccattttcaatagcttgagccacttcaagtgcggttaaactttctttaaaagaatccggtgcaatgacaattttcattttagttctccttgatagtgattgattaaaataattgccatacaccaaaaatcagagtagagataattgtcatgatcaaacctactgcagtttcgtatgggattagttttaaccgctctttaatatccatattaacactaccgccggttgcatgaaagaaagaaccatgaggcatatgatcgaagacggttgcaccagcatgaatcattgcagccgctgcgataccgctgacgctcagttcaattaaagttgctccgaacacttgagacgctacagcggttcctgctgtagtggaagctgtggctaatgacattaatcccccggaaatcggtgctaatagataagaaggtagtccggacgcagttaacccttcaattaagagttcttttaattcggaattagcgattacaccggctaatgttccggtacctaacaacatcacagcaacaggtgccattttacctaatcctatcactgcatattgatttaagtaacgtgttttattcatgcaaattgtgcctacaataccgccaagaggcagtgcgattaaaggatcaatttttatgccgaataatgggcgaagggcaagtaaaataatagtaaagagcggtgcaataattgctggcaagaattttggtaattcgccggtgatcccaacgatttctttttcacttacttttgagcctttattcattaggcttttggctagaaaataggtgatgattagaccaaaaacagcaggaatgatgcccgctgtcatcactgaagttagagggatgttgaaggcatctgatgcagcgatagcatttgggttaggagacataatattacctgctttaccacccccaatcatggctaacaaaatagccattttggataaattgctacgttttgccaatgccagtgcaatgggggcaactgtgatgactgcaacgtcaataaatacacctacagccgttaataacattgcggcaagaatgagtgccaacaatgatctggattcacccagtttttttacgatagtatcggcaatagtacttgccgcaccggattcaattaatacacctgccagcacaccagcggctaaaatcctcataacagcggtagtgataccttgtgccccgcctatcatcagcgtaactgtttggcttagatccgcacctccgattaaacctcccacaagtgcaccaataatcatgccataagcaggtgggacttttttcaaaatgagtacaattgcagtaaaaagggcaacaattgccccgagagcagttacagttatcatgatcgtttcctcatatattaataaaaaatcatgttgtgtattattgaatgtatgaggttaaaaaatcttcatatataaatacaaaaatacctgataaataggattattttttgtatatttatacaatttattggtttagcaatgtgcttaggtagagtgtaaatttttcatctatcttattgaaagacaagccggttattttctcaatcttgcttagacgataccttaatgtattgatatgaataaataattgttgtgaagtgagagtaagatcacaatttgaaaaaaaatactgttgcaatgttttttgtaacagatgattttcgtcttgttgatataaggtatcaataggttttaataactccttactttgccaagtactacgtaagttatctaataacgcaggcaatttatattgattaaagaaatagatggatttcttaggaaaataagtttccccataacgaagggtactaagtgcggtctgaaatgaaagtgaaatgttgcgattattttcaacttcggaaccgatagccactttcagcccttttaatcccgaaggtaatagataaggaggaaataatttctgtaatccttttgtaccaagtaaggcttgaagttcttcagccggttgtataagtgcgattttatcatgcgataagattgcgaagtggttgatcgattgttctaaatatccagcaagcttttgaagtttctctgctgtgggatgcaaaatttggataataatgaccgcacttttagtatgtagcgttagtccgaaaaaagcactttgtttctcaatttctgcctcgttgagtttaccttttaataaacctagaataaactcttctttataacgtttatcccaacgttctttttctaacaaaaagtgttgttcaatcatcaattcagcagtcattttaaccatttcaccataggatcgaacagtgtcgggatctccggaaatacctacaacacctaaaatttctcccaaataactaatgggaagattaatacccggttgcacttcaaataaccatttttcagctaactcctgagttatttctatagtttggttgtgacgaatagagtatatggcaccaatatgtctttgttgcaaacggtgaggattacttgaggcaataataatgccggtttcattcattacattgatgggcttatgtagaacacggtttgttcgttgcacaatattttgagctaaagaaacgcttaatttcatgttcatagcaggacatttactgtaattatcaatagagtgactctcattttatgagaattttagacaaggtaaaagtataaaatttcagcaagtaaaaaatttttttaaaaaattacttgcattgaaatataaaatgcctataatgcacggcacacaacgacacgctgttgtgagaggttaagcagtgtgtcgttattttttgttctttaacaaactatcagacaaactgtgtgggcacttgtgaaactgtattaataagagattaaaagagtaagataagtgcttaaactagagaaattcatagagaaaagatggataaaatagtcagtatttattgagcgaagagattaaattgaagagtttgatcatggctcagattgaacgctggcggcaggcttaacacatgcaagtcgaacggtaacggggagggagattactttctctgctgacgagtggcggacgggtgagtaaagcttgggaatctggcgaatggagggggatagccacgggaaactgtgggtaataccgcgtaatgtctaaggaccaaaggggtgggactgtgaggccacctgccatttgatgagcccaagtgggattaggtagttggtgaggtaagggctcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcgccagaagcattgctgggtagctaaatgcgggagagataagtgctgaaagcatctaagcacgaaacttgccttaagatgagttctccctaatgaagagttagtaagggatgtttgagactaagacgtagataggtggggtgtgtaagtgtagtgatatattgagctaacccatactaatttcccgaggggcttaaccatacaatcttgagtgttttgcatagaggaagaagcgggacaggatagagagaggaatacttgaagtagaggcttgtttttttattgaagaagagatagagacgggatataagagagaggaatttaacttggcggcgatagtgcggtgggaccacctgacaccatgccgaactcagaagtgaaacgctgtaacgccgatggtagtgtggggattccccatgtgagagtagggcaccgccaagttttttatgatatggccctgagtggagacactcagggttttttgttatttgggataaggcggggaagagagaagagggaagaggaaaatgggagaaaaaaagtaataaggtgataacaaggtagtcataaaaagtagggtaatgaagcagagtgaagaggtgcggtaggaaaatcgtttttttttctaccgctctttttktaggtratttatttatcgtttgccttattcatacgtccggcaaacaatatctttttcttcacaaaacatctcactatgctgtgcttgacactgtctttgtacattaagtttagctcgkcctctgttgstatgctcactgcgatattcttgagtaaatggttttaatgtacaaacatgaatagcatcaaaatcagtttgttccgaaacaccgatgaaaattggaactggaatggctgtttgatcttttgttgatgtcggtacaacgcaacttgttaataatatacacaaaccgattaaacaaaaacgcatatttttctcctaaaaataaccttaatttcaaattttaagacgattttattatactcaatttttacaagaatgttcagagaaatgacaaaacatatagttttactttttctccataaaaatgtaggcatgatgtaattgaaactaagttgtatctcgtgtttaattaacattcatgccgatatcgaaaacatataagcaatatttgcttcgtttgttacaaattatttttcaattcgtaatccataagatttaaatttctctaatacaatctccatttcttttggagttaacaatgggatttctaaacctgtcgctaaaagtttcatgtaccattgagccaagacttcaacttcatgggcaagccataatgctttatcaagatttttttccgcagcaattaagccatggtgtgctaataaaattgccttactttcttttataccttgtttgacatgctcagccagttcatgcgtaccaaaggttgcataaggaacacaaggaatatgatcggtaccacctacggcaatcatgtaatgaaaaggaggaataggtttttctaaaatagatacagctgcacaattgattgaatgattatgtacaactgcatcaacatcaggacgtgcttcatacacagctagatggaaatgccattcactggaggggaatttgccttcttcatgtttgccatgtttatctacataaacaatgttgttttcagtcagcaattcatatggcatgcctgtagaagtaattaacataccgtctttatatctgacactgacgttacccgcagttccttggtttaaaccaagtcttgtcatttctaaacaggtgaagataattttttttgaaagtagtgatctatccatttttattgtccttctatttcacaggtgtaacaccttttttaataataatattgccgtattttgcagtttcaccggtaataactactgcataagcctgttttgctcgctcataaaaagcaaaacgatccattcttgctaatttaggcacattacctaccgcacttttaattgtttgaagatagctttgctccacagcgggatccaaactatccccttcaactgcttgcatcataattaacggtgcctcagtataagtatcaaactcaaataaaggggcaatacctgtcagtaaagaattgatactaataccgtcagcacgaacaactttatgatgcaattgatgagctggaaaatgagcatcagataaaactaactcatctccatgtcccatttctgctaaaattttcaacaaatccggtgaaattgccggatgaatcccttttaacatatatcctcctgaagttttttataaaattccatatctgttgaaggttcaattcgtcggaatgtcggcttcattttttgctgtgcctcttcgacgtttgcaaaaacacccgcaccggttaaagtaaacatagctgcacccaatactgtactctctgctatatcaataacatcaatagggcaacctaagacatcagcacgaatttggttccaaagtttatttttagatccaccgccaaccacaatcaaacgatccgcactaaaatttcccactttttgtaatacattcaagcctgcttttagacggtaagccatgtattccaaacctgcacgataaatttcgccacgtttcgtatgcattgataaacctttgatttcacctgtttgttccattttgccgtcaaaatttcctacgagcttcacgccattggaaccggcaggtactgttttgccctctgcgatcatagtttggtaatattgctctttggttacatcggaaaagaattgtttgcccaaccattcaatcacacccgaactaacccattgcactcccggattaaaagcaccaggcagactatcaaattctatggttaaaccatctctgacatattgccattgtgcttgagcttgctgtgttcttaccattaaaatttcccaagtgcctgaactcaaaacaggttggttatatccggcaccggaaccgaaaatagcaaattgagtgtcatgtccacaggaaagtactgggatatgtgttgataaacctaaatattttgccacctcaggtaataaattacctattttttcacccgctcttttcatcggtgggaaatgttgttcattcaaacctagaaaatctaaaacctctttatcccaagagtcattttctatatttgtcatcattgatgtacctgccatagtacgatctgtactaaattgacctgtcaaacgttgagttaatatagatgaaatgaatacccacttatccatctcggcaaaaatatccggtttattttctttcaaccacaataatttgaacaatgtattgaaactatattgtccaataccattacgctgatagagcttttttacatcaaggtattgatgaagtttctccatgacaggcaaagtgcggggacatttccaagaaattattggaaaaatttgcttcccatttttcgaaaaaggagcaccatctacaccaaaggtagtaataccaatccctttaatttcagctacatcaatttgtttttggcgtagattcacaattgttttttctgcacaaaaaataagtttttggtagatttcttcaatgtcccaaatatgataaagagagttttcaggatcaggttgagtgtgattaggtgtatgatgtgatgcaacgattttacctgcttcatttattgcaatggtacgtaaatttgttgcaccacaatcaaaaatcaatgcaattgccataataactccataaaatcatgagcttattgcttaattaagaggggaaatttagtccttccccctccccctggatttcataaattaacgatataaaggaccaaagtttgcacaagcacggtaatcttgaccttctttatcttgaccaaatgcactccaagcacttggacggaaaatgtctttttcttcgacattgtgcatacagactggaatacgtagcatggaagcaagagtgatcaaatcagcaccaacatgtccataacttgcaacgcaatggtttgccccccaatttgccatgacagaataaacgtcagtaaatgctcctgtacccgttaaacgtggaacaaaccaagtagttggccatgtttgatcagtacgtttatttaaaatatcatgcacgttttctggtaaagcaatagaccatccttcggcgatttgtaaaacaggcccaatacctttgactaagttaattctatgtatggtaaatggcatcccgcctttagttaaaaattgtgacgataaaccgcctcctctgaaatattcgtgtaccgccggacaccaacgagtattttctaagcaacgctttccatcttcttctgttacttcccataccggtttaatgactgatgttccgtttggatctgtatgttgtcccgtaccatccaaagcggcagagccggaatttagtaaatgaataaatccactttcaggacgccaacctgttacacgctcaacagaatcttcactccaataggtacgtacatcagcaaaaatttgagcctgaccggttagcaaattgccgaataacatgttaacgccatttaatgaatcattttctgtggctaaaatataaggaggacgtacaccgttccagtcataagttgaattcaatattgcttccataaagtcgccgttcggtagatgatctgtccaatggcgttgaccttggaaaccagcaccaatcgcattatgtcccattgattcttctacataaccaagttcagctaaacgaggattaccaaccattagatctcgacaaataatcgtcattttgacaacattttcccaaagttttgctcgttcttccgaactacgctgattttcttcagcatttacatcaataccttctttacagtattgagtgacccattccatcgctaatttaacttctttttcatcatagattttgcgatctaaacggcgtttaatttcggtcatatctacatattcattacgcatatccaaatattcttgaaagaatgcttgattaacgatagaaccggcaatacccatagaaactgaacctatagataagtaagatttaccacgtaaagtcgcaactgcgagaccggcacgagcaaaacgtagtaatttctctttaacatctgttggaattgttgtatcagatgcttcttgaacttcagtaccgtaaatagagaatgcaggtagccccatttggttatgtccggcaagagccgctgccaaatacaccgcaccgggacgttctgtaccgttaaagccccaaattgcttttggcatatggggatccatatcgattgtttcagaaccatagcaccagcaaggggttacagtgatgactgcaccgacattttcacgtttgaatttttcagcacatgcagcagcttcagcgacaccaccaatcgtggtgtccgcaattacacatttcacaaattgcccatttgtgtgccgcacttccgtttcaattaattgagcaaccgcttttgccatattcatggtttgatcttctaaagattcacgaacgcccatacgacgtccatcaatagttggacggataccgatttttaccggtgttgattttaaatgtgtcattttttattccttcttgatgattaagtttattttttcacaaaaaacaacagaacatagttttttgtgtaatttgtaaaattttcgtgagataaatcacaaaaaaatccttttttgggttaaatttcttgtttttatttgcccgatttttaaatgattcatgatttttcgggcaaaacgatcaaatcaggcttcgaattatttcaataccttccaacttctatagccataaatagtaattggaataaaacagattaatggtagaacaaaagaaatgttcacagcaggcaaattaaaaatttcacctttatcaatgatcatgccttgtaaaggtggcattaatgcaccgcctacgattgccataactagaccagcggcaccaagactagcctcttcttttaaaccgtataaggcaataccgtagattgttgggaacataagagacataaaacctgaggttaaaattaagcaatataatcctaattctccatcgataaaaattacgcctacaatgcttaagaaaccgccgataccaaataggcataacatcaactcagcttttaagtatttcataatactggtgctgataaagcgactggcaacaaaaattatcattgcaataatattaaaattttgtgcttcagatttagtaaaacctaagcgttcggcatattggataataaaggtccagcacataatttgaacacccacatagaaaacctgagcaattacaccttcacgatactttgcattttggattaggcgagaaaatgcgtctttgaatgcaattcttccccccccccctagctcttccatttttgtagtaggcattttgtataaactaatgactaacatgatgattaaaacgacacctccaacagctaaataaggattacgaataatttctaaatcatgggtgcgtatagtcgctttttctgcggtagataaggtattaaaaattagatttcccattgcatcacgtttttcagattctaggctggttaatactacttgtgatgccacaaacatacctgtaatcgaacccaacgggttaaaagattgtgctaaatttaaacggcgggttgcggtttgcggatctcccatcgaaagaatatatgggttggctgtagtttctaaaaaagctaacccaaaagtcagaatataaagtgatagtaagaaaaaagtaaattcttcatacaaagctgccggatagaataagaatgcaccaactgcataaagggctaaacctaataagacaccggatttataattaaatcggctgacaaaaagtgcggctggaattgccattgttccatagcctccataaaaggcaaattgaacaagagcagcttctgatgctggaatttccataacagtttggaaaacggctaccattggattcgtaatatcatttgcaaatccccacaaagcaaacaaactggtaattaatataaaaggtgcaataaattgcttttcaagagttttagctgtcatttttctttccttaattatgagagtagtttcaaggattacattctcgtaaaattatgctgcgtgctttgcatcattttttgaaagaatgttaaaactattagaaaggaaaaatagaaagacaataagaaatttatgaaagtagttaaatttctgtgaaattcatcacaaaaaacgctaaaaaaattaaaagataatgcccgaattaaatcaattcttttgtaaatcgggcattattttgtttggataaagaggatttaaacaatagtgattaaaacatcagatttctggcagtatgatgtcaaagttggatttggaacttggtctgtaaataaaatatctatttgtgataaatctgttaaacgaatcaaatttctacgttcaaacttagaactgtctaataagagaaatttctgttcacaagcatccattaatttacgtttaattgaggcattaagctcatttgattcccaaactccaccgctactatcaatgccggtgcaagagaaaatcccaatatcaatatgtaaacgttgtaataattgttcggataacggtccataaaaagcatcatatttcactgaataaacgccacccgttgcaatggttttaatattaggtttattaacaagtgcggtaatgttatgcatagaattggtcactactgtgcaaggaatatcggggatcatttgtgcaaaatgccagctggttgaactggcatccaaaccaagtacaataccttcaaacatatattcaatggcggaagcggctatggcacgttttttatcgcaattaaagcgttgtcggctttgaaaagaactcccgacatctttcgctttacggctgacagcacctccatgtacacgatgaattaaccctctcttatccagatcggttagatctcttcgaatagtttccacagatacgtcaaattgtttagctaaatcatttacattcacttttccggatgaatttattaattgcaaaatcaatgtttctcttgatgacatttcttttctccaagcagtcaagatggttacgaaagattacacgctaaacgatagtaagatcaactgttgaaaaattaccgcactttgccttaaatttattttactgtcattggtagtgttaatatgttcaagaagaattgcgtcagatcaggaaaagctgacttttcactttaaaatatactcattttttgctataaagtcggcagttttttacttaatacttaggagatattttatggagttagtatttattcgccatggttttagtgagtggaatgccaaaaacttgtttactggctggcgtgatgtgaatttaacagaacgtggtattgaagaagctaaagcagcaggtaaaaaattacttgaagctggttatgaatttgatattgcatttacctcagttttaactcgggcaattaaaacctgcaatatcgtgttagaagaatctaaccaattatggattcctcaagtgaagcactggcgtttaaatgagcgtcattacggtgctttacaagggttggataaaaaagcaactgctgaacagtatggtgatgaacaagttcacatttggcgtcgttcttatgatgtttctccaccggatttagatccgcaagatccgaattctgcacataacgaccgccgttatgctcttttacctaaagacgttgtgccaaatgctgagaacttaaaaatcactcttgaacgtgttctgccattctgggaagatcaaattgcacccgcacttctttccggtaaacgtgtacttgtcactgcacacggtaattctttacgtgcattagcaaaacacattatcggtatttctgatgaagaaattatggcttttgaaattccaacaggtcagccgttagtgttaaaactggatgaacagttaaattttgttgagaaattctatctataatttctttatatacctaatcaatggctgagggtatctcagcctttttgtatcactttttacattgatttgattttatcttgtcgcaattcctctttaatttctgtacaattggcagattttgtgtttattgagatattctatgagttcatccccaaatattggctttatcagccttggttgccccaaaaatttagttgattctgagcgtattctgacagagttacgttctgatggttataatattatttccagttatgaaggggcggatttagttattgtcaatacctgtggctttattgatagtgcggtgcaggaatcattggaatctatcggagaagctttagagaataacggtaaagtgattgtaactggttgtttaggggcgaaagagaaccaaattcgtgaaattcatccgcaggtgctggagatcacaggtccgcatagctatgaagccgtgatgaaacatgtgcataaatatgtacctaaacctgaatacagtccttatactagtcttgtgccgaaacaatggataaaactgacgccaaaacattatgcttatttaaaaatttcggaaggttgtgatcatcgttgtactttttgtatcatcccttctatgcgaggtgatttagatagtcgttccattgtgcatatactcgatgaagccaaacgccttgtagatgctggtgtgaaagagattttggtagtatctcaagatacctctgcttatgccttggataagaagaaagaaaatgccagtaaaacggtattctggaatgggatgccgattaaaaatgatctgattactttatgtgaaaaattaggttcgctcggtgcgtgggtgcggttgcattatgtttatccttatccgcacgtagacaatctcattccattgatggcagaaggtaaaatcttgccttatttggatatccccttacaacatgccagtcctaaaattttaaagatgatgaaacgcccgggttcaattgaacgtactttagagcgtatcaaaaaatggcgtgaaatttgtcctgatttaactttgcgttctacctttattgttggttttccgggagaaacggaggaagatttccagttattattggatttcttgcaagaagcacaacttgatcgtgttggttgttttaaattcagtcctgttgaaggtgcggtcgccaccgatatggaagatcaaataccggaagaaatcaaagaggaacggtttcaccgttttatgcagttgcaacaaaaaatttccgctgaacgtttacggcaaaaaattggtagaacattacctgtcattattgatgagattgacgaagaaggcattattggtcgtacgatggcagatgcaccggaaattgatggcgttgtttacgtagataatttttcaaaagtggaagtaaaactcggacaaattattaatgtaactattaccaacgcagatgagtatgatttatggggagagatttaagtgccgttaagtgcggggtgaattaccggaatatttattctccctcagaagcagtgatatattataaaattcaatttccaggatatgtatcatgttatttttacgacaaaaattcaaaaatagattaaaacttaccgcacttttttatgtagtttatttgcttttttcgtttgttgctcgtgccaatgaacttactcgcctccaagaaaaaattaagttacaagaacaaaaaattgcacaacaaaaaaatgaacaaaatgaattacaaaacatattaaaaaatcaagaaaatcaaattagtcaagcggaagataaattacgtcaaacagaagaaaatttgaaagaaacacaacaacttatcagtgcaacagataaacagataaaacgcttggaaatgcagctcaaaagtcaaaaaaaactgcttgcagagcaaatagataaaatgtaccgagctgagattaattcttccgcagttgaaaagttgttttctcaagaggcacaaaaatctgaacgtatgcagatttattatcgtcagatgaatcaaactcgtttaaagttgattaatgaaatccaacaaactcaagaacagctggagaatgaaaaagcccttattcaaggaaaaagaaaaaatcagcaaaatcagctgacaacacaaaaacaacaacgacaagaactacaaagattacagcgtgagcaacaattaatgcttgaacagctgaatcaaaatttagtaaaagatcaaaataagttggagcaattaaaggcaaatgaaattactttgcgtcaacaaattcagcgagcggagaaaattactaaagagaaggaacagcgagagcgggcagcattggcacggaaaaaagagtcggaagaaaggaaaaaccgaaaaccttataaaccgacagcacaagaaaagcaacttatggcaagtaaaaaaggtttaggtgttgcaaaaaaacagtattcttttcctgtacagggtaaagttgtacaaggtttcggtacaggtcaaatgggagaattgaaatggaagggcatggtaatttctgcggtaaaaggttctccggtaaaagtaattgcagatggacgggttattttagtcagtcgtcttgcaggttatggtttaatggtaatcgttaaacatggagagcatgatctcaccctgtacggttacaatcaatctgctatggttgaagaaggacaatttgtgaaagccggacaaaaaattgctgaggttggtgatacggggagttatgcacttccggcactttattttgagattcgtcgtaaagggatacccgttaacccgatgggttgggtaaaataaaatgagaagaaatatatgtattaaaagtgcggttaaaatcagtcttatggggctaatcctgagcattgtatcgtcttttatttatgctcaacataaactggcgattgtaattgatgatattggatatcgtcttaaggaagataatcagatttattctctgccaaaagaagtttctgttgccattattccttccgcacctcatgccaagcaacgtgatcaacaggcaaaacaacaagatagagatattttaattcatttgcctatgcaaccgcttaatctgcaaaaaattgaagacggtggaataaaattaggtatgtcgcaaccggaagtttatcatcgagtaagaaatgccaaaagtattttacccaatgctataggtatgaataatcacatgggaagtgcggcgacagcggataaagatttaatgaacaaattaatgaccgcacttttgcaacaagatttattctttcttgatagccgaaccattgggcgatcagttgcggggaaaatagcgagagagtttggtatacccactttggaacgtcatatttttcttgatgatagtgataaacttagtgatgttcaacgccaatggaatgcagccattcaatatgctcgtaaacggggaacggctattgtgattggacatccgagaaaaaatacgattgcagttttgcaaatggggataaaacaattaccaaaagatattcaattagtgggtattggcagtttgtggcgtaatgagaagataattcctcagaaaccttttatttatctgtttaatgatatacccgcaccgacatcgcaagcaccatttcaaactattcctttgttaagaggagtaccgaccgatatataatagaaaatacatgattgaagaataaacctctgaaggattttcagaggttggaagttaagggcgaatgtctcgtaagataggattttgcatagaaattaatgtttctgtagattgaatttcatcaattaattgaatttttgtagcaagaactgaatgaagttctgcaatagtatgggtcatgactttaataaaaatagaatagttaccggtcgtatagtatgcttcaactacttcattgatattctctaattgcttgataactttgtcgtaatctttagcactttttaaaataataccgataaagcaacatacatcataacctaatttacgttcatcaatgcggatttttgtgccttgaatgatgccggattgacgcattttttctactcgcacatggatagtgccgggactgacaccgaaatttttcgccatttctgcataaggtgtacgtgcatctttgattaatactcgtaagatttgttgatctaattggtctaaatttggcatatttatttttccttattattcataattagaaaatatataaaaatattatgctatttttaatataaattcaatattaataaaaaaataaataaatggtattgaattagtggtatgttttattaaataatacctaacgtgaatttaatattcaattactcgttattaattattaggatgtatgtcatgaaaaaatcatttattttacaacaacaagaaattagttttgctaaaaacacttttacagaaaaattaatcgaacatttaggcatcattgaagtgcaaggacctatcttaagtcaagtgggaaatggtattcaagataatctttcaggtacagagaaagcggttcaagtaaatgtgaaacagatcactgatgccaaatttgaagtggtgcattcattggcaaaatggaaacgtcatacattagctcgttttaactttgcagagaatgaaggcttatttgtacatatgaaagcattacgtcccgatgaagatagtctggatcaaacccactctgtttatgttgatcaatgggattgggaaaaagttattccaacaggacgtcgcaaccttgcttatttaaaagaaactgtacgttcaatttatcaagctattttggaaacggaagatgcagtacaccaaaaatttgggttgagtaaatttttacctagagagattacttttatacacagtgaggaacttgttcaacgttatcctgaattgaacgataaacaacgtgaaaatgcgatttgtaaagaatatggtgcagtattcttaatgggaattgggggagtattatcagatggcaaaccacatgataagcgtgcacctgattatgatgactggacaacaccgtctgaaggtgagtatttaggtttgaatggtgatattcttgtttggaatcctgtattggagcgtgcatttgaagtatcttctatgggcattcgtgtagatgaaaccgcattacgtaaacaactggcattaaccggtgatgaagatcggttgcaatttgactggcatcaagatcttgttaacggacgtttaccgctttctattggtggtgggattggtcaatctcgcttggcgatgttgcttttacagaaaaaacatattggcgaagtgcaatcaagtgtttggccaaaagttgttacagaacagtttgaaaacattctgtagtgtgcttttgaatattatattgaaaaagtgcggtaaaaataccgcacttttttatattaacgctggtgtattcttgatagaatgagcactcacttatgcttaataaaatataatttatgtataactcattttcttctttatttgaacaagttttgcagtctcccgattttatcattttaataaagatgtctgttgctatgctattgggtggagcaattggcttggaacgggaattgaagcataaaccggttggtgtaaaaacttgtgtgattattgcggttacaacttgtattctgaccattgtgtcaattaaagctgcggaacattatgcacaagtttcagaaaatatccgaacggatccaatgcggttagcggcacaagtcattagtggcatcgggtttctaggtgcgggggtaattttacgtaaaagtaacgatgctatttcaggattgacaactgctgctattatttgggcagctgctggtattggtattgttgctggagccggcttcttttttgatgcttcagttgctacatttatgattttaatcgcagttcgggtaggtccgacgttacaacaaattatccgtcgcagtacacgtagaacacgtaaaactaaaatttatattcaacttagttcaccattgatcatcagtaacgttacggatattttaattaataataattaccgaattgatagtttatctgtcaaagatttacaaaatggagaagtgcgtttaaccattagaggattaatcacagataaatcgaaagtacaaggcgtttatttgttactaaaagatgaagaaggcgttgtcagtattgatttggctaattaaaagaaaaatccagatatttaattgatttgctccaaaagttgtactacatacaccatcaacaaattaaggggcagattttttatgatcaaagggaatatctccttaaaaattttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgacaaaatgccgtgagggcggacagcttaggcgtttgttgagtaattgggtaaatttctctatctcgcttttacggcgttcatcttcccgccaagcggtttcattcgcatagtgcatcatatagcggttgctgattcggtgatgaacccctgtcatcattcgcctaaatcgagcgaaaaacgattcggcaaggttgttggtgatgccgtctattgagcagtattcttgtgagtgattcactcgttctaaccgataatgaatgttgagcaggccataggcggcattttcatctgcacaaattacgctgttggctttcactaagtgatgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttctcttttttcaggctgtggaggtttggatcttggctttcaccaagctggttacgaaacagtttgggcgaacgacttttctcattgggcatgcgaaagtttccgtaaaaatatcggtgatgtaattgtagaaggtgatattgaacagattaacccaaatgatcctacgattcccgactgcgatattattcttggtggttttccgtgccaagacttttcgatgatttggaaacagcctggcctagatggcgagcgaggcaatctttacaagagctttttacgctttgtgaatgccaaaaaaccgaaagtgtttgtagcagaaaatgtgaaaggtttgctgacagcaaataagaaaaaagccattcaacaaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaagaaaatttaaaaggctaccctctagtgattgtggacgacgaagctgatgcggcaagcctcaatactaatgtaaataaacatgacaaagatgctagtacagtcaataaattattaaatgaaatcaaaaatagctgttgtcaaagtttatttattcaattaacggcaacgccacaatccttattgttgcagcacttggagtctaattggcagcctgattttattcatttctttgaaccaggtgagaaatatattggcggaaattttgttttttccgatccaccaagttatattttccgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatgactcaacattaccttctttccagcaaagcccgcacgcttcgtcattacagatagcccgcctatctgatgaacaagcgtttgcgatgctgtgtgaaattcgttggggaagtcaggaaaatgtgtgttgcccgaaatgtggtgtacaacatcaagcctatttcatctctactcgcaaacaatggcgatgcaaacattgtaaacacacctttagcattacatcaggcacgatttttgcgaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcagatacccctatcacagctcaacataccgtatcaatgcgtggggcgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatctcattcgtgttgagccatttatcaggctgtgatttcagtatattggcaactaatttttgtggggaagtaataaaacgagcatttctctctttcttaccagtggaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatctttgtgcaactgctacataataccnaaattttatccttttcacttgagctttatttttaatctctgtataatcgccaaccttacagccacagttaattttcgttccttgcttccgcaagattggtggctgatcttataatcggaggctgattaacccgtaaggagcagtaatgcgtcactacgaaatcgtatttatggttcatccggaccaaagcgaacaagtacccggcatgattgaacgttatacaggttctgttaaagaagctggcggtcaaatccatcgcctagaagattggggtcgtcgccaattagcgtacccaatcaataaattacacaaagcacattatgtgctaatgaatgtagaagcgcctcaagaagtcatcgacgagctagaaacaactttccgttacaacgacgcagttcttcgtaacgtaattattcgtactaagcacgccgtaacagaagcgtccccaatggttaaagcacgtgaagagcgtaagcctttaactgaagttgaaaacaacgattttgaggatgctgaagagtaatttagaggttgataatcgtttttcgttaattggcaaagttgctgattttccaaaacgaaacaaaagcccaagtggaattgatcattgccttttctatttggaacatcgttcaaataaaaaagaggcaggttttacccgtcaagcatggtgtaaaatagccatccaaattagtggcaatcaattaatagagaaaactcaaagcattacggtcggtcagcaattattagttgtaggttttgttacttcgcatagaagttcaaatggtttaaatcaattagtattgcatgccgagcaaatcgaatttatagagtaggagactagccaaatggcacgttatttccgtcgtcgtaagttctgccgttttacagcggagaatgtggtagaaatcgattataaagatattgctacattaaagaactatatcacagagagcggcaaaattgttccaagccgtattaccggtactcgtgcgaagtatcaacgtcaattagctcgtgcaatcaaacgtgctcgctatttagcgttacttccatacactgacaatcatcagtaatttaaggagaatacggtaatgcaagtaattcttttagataaaattgctcatctcggtaacgtaggtgatcaagttagcgttaaagcaggttttgctcgtaacttcttaattccacaaggtaaagcagttatggcaactcaagctaatattgaatattttgaaagtcgtcgtgctgaattagaacgtaaagcagcagaagttctagctacagcacaagctcgtgctaatcagttagcagaattggcaactgttactattacatctaaagccggtgatgaaggtcgtttattcggttctatcaccgcacgtgatgttgctgaagcagtaactgcggcaggtgttgaaatcgctaaaagtgaagttcgcctttcaacaggaccacttcgcacaaccggcgaacaccaagtccgtttccaattacacggcgaagtatttgcaacattaaatgttgttattgttgcagagtaatcattaaaattataatgacagaacccaacttttatgttgggtttttttatatctttgttgccccaagtaatcttatagctaaattctttaactcatacattaatccacgtatttttctaacataacattattcatttctattttttatcctttatcctttatcctttatcctttgacaaccttagtagctttaattcaattataataacgcgctgttttcttactaactctttgagaaatagtaatctccgataattcctgtaatgatcatgggcttattgtaatctctgctattgtgtatgggatattttaaaatctaaataatccgatacggtgtgccgtttcttttttgggtataatctgtcaatcttcttttactaaaggagattattgatgagtaaatcaaaagtaatattaatccgatatatattgtgctacaataagtgcggtgcatggtgcatggtgcatggtgcatggtgcatggtgcatggtgcatgcttcgatataatatattttgagtgaggaatttgcgatgtcctatttagaacgtgcaagagagctttttgatgaagcaaaagcagtgagaagacaaatccatcaacaccctgaagtgggttttgagttgcccgataccatggcgttgattaagaaaaaattggatgaacataatattcagtatcgtcaattggacgatgcctatgctctagtggggacgttgggcgatccgagcaagggtaagacgttgttgttgcgtgcggatatggacggcttgccgatggtcgaagaagcgaatttggaatttgccgccaaaaatcaatgtgcacatttgtgcggtcatgatattcatgcgacaagtttattggttgccctgatcatgctcaaagaagatgaagataagttgcaagggcaaatcaaatttttattccaacctgccgaagaaacgctgaatggtggcaagttgatgatcgaaaaaggggtgttggaaaacccaaaaccggatgctggtctagcactccatatgtggcctaatggtgaaaaaccagggattttgataaataaagaagctgcattggcatctgcattgaattttaaaatcgagattaagggcaaaggggcacacggtgcgatgccttataacggtgtcgatcctgtgtttgtggcttcgcaaattattaacggtgccaacggtattttggcacgtgagttgccttccagcaaaggggcttctttatccataggatcgatcagtgcaccgggcggggcaatcaatattgtgcctcctaatgcgtatttggaaggaacttcccgctcgttatacgatgattcggctaaacacatggcaaaacgattgcctgaaattgtcgagcatatcggtaaggcattcagagccgagacagtctatgaggaagtagcgaatgtgcctgcgttggtcaatacgcctaccatgtctgagttggtcaaagcttctgccgaagaagccttgggcccggaatatacggtgaaatatattgatcctcttttagcttccgaagactatgcccatatcgccagtcaattgcctgaatcctgctatttctttgtgtcttgcccgcaaccggatgcggacggcaatgtctatgcggtacaccaccctaaagtggtcttcaatgaagaggcattgattatcggccctgcaactatggcacaagctgcggtgaactggttagcaagtcatcgttaagggggtgactcaatgagccagtgtggtgtgtattgaaatatcaatcccattggcttttttgtttttgaattaaaaatatttcattcaaagttttccgtcaatatccgctttgggatcccttgccatttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaacatgattaccaaacacaaccttcccgaattattaaaccatctcggttttaccgaacagaatcaaatctaccgcaaagtttttcatgggcaatatgaattaagcgtggatttcaaagcagaaaaaatccattatcccaatggtttaaccgccgaacgcgacaccacgctcaatttcagccagcctgaaaatttcgtggtgttggaatgcgtgtgccacttattgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccgatacggaaaaagcagatttgtttgaacaaagtgcgtgggcgtttgcgcgtgaaatggaaaaagacaaattgcattattttttattggcttatgccaatccgcagcctgtactcatcatcaaaagccccgccgacaacaaagaagcgaaaaaattcttgggctatgaatggagcacacgcaaaggcagcgaaggcatcaaatacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgccgaactagtcaaattaagaaaaaaacggcaaccctacctcatttcttcctgaaagtgcggtgtttttttgcgataaaaatcattttgttgattaaaaacttttcatgaagacaaaatatgtgattttttaaatgaaaaaattgctatttacaatgctgtttattgaatcaaatggttacagatcaatgctatcgttttttttgtttttgaatgtgaaataatgaagcgataatttgatttaatttatgtattgttatttaatatgcctatccgttggtaacggcgattattttattaagcatgacattacgcttgctgtctacactgtcaataaaacacgtttatgtgatggtctggggagtattttatgtcttgtttttgtgtgttgttgtaatctgtatatgagttttttttggagtatctataatggaaccatcctaccaggaacaaaacaattgtactgaaacgattaaaatcaatgaagtcaaaaaactttggttggacagtaaattttcccttaatttacctgtatggacattgttgttgcctttatttgcattattagtattggcatttcatttgctgactcacccaacaggctggttgattaatactgttactacggttttgcttatcggttcggtatttgctgcagtgcattatgctgaagtgattgctcataaggtgggggagccgtttggtacgttggtgcttgcaatagcggtaaccgttattgaagtggcattaattgtgatcctgatgagtaacagcacgcaggaaaattctttggtgttggcaagagatacagtttatgcggcattaatgttgatttgtaatgggatcgtgggtatcgggctgctgataggcggtatgaaaaattatgtccaattatttagcttgcacggtattaaggctgctgtcagtgttttactggcaatttcattaattgtttttgtgttgcctaattttacgctttctgccgagggtggtggaatggtcaattcacagctgttgttcgtggcaatgtgctgtttggtactttacggctctttcatttttacgcaaactattcgccatcgtaattattttgttgatgaggatgaaaatgaaagccatcacaacgacaattggttaacaattggtgtgagtattgtgtttttattgataagtttagtttctgtggtaggactggctaaaatgctatcgcctactattgagtctgcactagttagtttcggattgcctaaaataatgttggggattatcgttgccggtttggtattgttgccggaatcaattgcttcaattaaggctgcctataataaccagttgcaaaacagtctgaatcttggtttgggttcggcattagcgtctatcgctttaactgtgcctgtgattgcgattatttctgttatctccggtcagcctattgtgtttggtttaacagccaaagaaagtttgatgctgattattacacttttattgacaatgaatactttaagcacaggacgtagcaactttttgttgggagttattcatttggtaatgttagcaacttttattttcttttccatcattccttgattttgaaatgaatgatttacatcagtaagtacgaagagaaaatcaatcacattattatcgggcagaaatatatgaaaaatagaaatttttattttggattgggttttattgctttgcttaccattatcgtgagttggttggcaaatactcaatttgcacatcaagcgaaaatcagtgctttgactatcgcaattttgttaggcattgtaattggtaataccttttatcccgcactttcatcaaaactggacaaaggcgtgttatttgccaagggaacattgctacgtattggaattatattatatggcttccgtttgactttgcaggacattagccatgtgggaatcaatgccattgttacagacagtgttatgttgctttccacttttttccttgctattgggataggaatttattggcttaaaatggacaagcagacggtgtatttgacggctggaggctgtagcatttgtggggcggcggctgtgatggcaatggaacctgttaccaaagccgaatctcataaagtatccgttgctgttgcggtcgttgttatttttggcacgattgccatgtttctatatccgtttgcctattcttatttacaacattggctaacagatcatcaatttgggatttatatcggttcaacggtacatgaagtagcacaagtttatgctgccggcggtaatattggtcctacggttgctgatacagcagtaatcaccaaaatgattagagtaatgatgttagcgccatttttattagttttatcttgggcattatcaaaacagaaatcagataaaagtaaaattaatattccttggtttgctttcttatttattctcatggcaatctttaattcttttgatattttgccaaaaagtgcggttaaatttatcgtagtcttagacgatttactgttaattgccgcaatgatagctttagggttgacaacgcatattagtgctatcaagaaagcgggagtaaaacctttattattagggatgttactctttatttggttggttttaggaggattagcagtgaatttggtaatgcaaggatttttataaagataaggatattattttgaacaatcttactgaaacgtttactctcgaacctcaagataatgcacgcttacaatccctttgtggcacatttgatgagcatttgcaattaattgaaagcagttttaatttggttgtttcacgccgtaattttacttttactgtacaatccgcagacgaagaagaaaaaaacacgtaccatccaactttgctaaaaagtgcggtgaaattaattaaaaatttatatgctgacactgcaaaaattcgtggcaaagtgaaagagctggatttggaagatatacatttggcaattcaagagagccgaatgttattacaaaataatactcaaacaaagcgggaagatagtaaagtttatagcacaacgattaaaactaaacgtggcttaattaaacctcgtggcagaaaccaaattgaatatttacataatattctcactcacgatattagttttggtattggaccggctggaacagggaaaacttttttagccgttgccgcagcggttgaagcattagagcgtcaagaagtgcgtcgtattttgcttatacgtcctgctgttgaagccggtgaaaaattgggttttttacccggtgatttaggacagaaaattgaaccttatttacgtccgctttatgatgctttatttgaaatgttagggtttgagcgtgtgcaaaaattaatagaacgtaatgtaattgaaattgcaccgttagcttatatgcggggacgaacgttaaacgacagttttattattttagatgaaagtcaaaacacaacggttgaacaaatgaaaatgtttttaacccgaattggatttaattctaaggctgttgtaaccggtgatgttacgcaaattgacttaccccgtagtcaaaaatccggtcttcgccatgcgattgaagtattagaaaatgtgccagaattaagttttaactattttgacagcaaagatattgtacgtcatcctgttgtggcaaaagttgttcaagcttatgaggtttgggaaattaaagatgagtttcgtcgccaacaattagccgagcaaaaacaacaagagcggttagaaaaagagcagtttaccgaagaacgggtaaaagcgttacaagaataattttatacaaaggttcaattcatgaaaaatgtcattattgacctacagatagcgagcgaagatgcgaccaatttaccaagtgtggaacaaattcaactatgggcaaatgcggcaattcgagcggaaaacttacaacctgaaatgacagtacgcattgttgatgaagaagaaagtcaccatttgaatttaacctatcgtggtaaagataagccgactaatgtgctttcttttccttttgaatgtcctgatgaaattgaattaccattaattggtgatctagtgatttgtcgtcaagtagtagaacgagaggcgacagagcaagaaaaaccactaatggcacattgggcacatatgatcgtacatggtagtttgcatttgttaggttatgatcatattgaagatgatgaggcggaagaaatggaaaggttagaaacggaaattatgctttcgttaggttttactgatccttatattattgagaaataaccaacctgaaatgatatctcctcgccatgtgcaaattagtattgcacccaatctgcaagattttggaccgcactttttatcacattttgatgttttgtggttagggtgggaaaaacctgattttaatgtgcatttttgccatgtgcaaaaagcaaaaaagttacttgggcaagagtttttaaatgtgatttttgatgctcgtcagggatttcatttagaaagtttagcgattgtggcaggaacagtaaaagcgggtggaacattaaatattctacttaatcattgggatcttttagaacaacaagctgatattgatagtttgcgttggagcggtgtagaaggaatgattgcaacaccgcactttattcagcattttcaacgaattgttgaccaatttcagtttcctattaatcatttcacgattccggcgattaccccaaataatctacctgatttattttgctcagttcaattgagggcaactaaagcacagcaaaaaattattgacagtattttacagcaacaggcagatatttattttttaacagcaaaacgtggacgaggcaaatcagcattattgggtttgttatctcaacaagtaaaacagaaagtttatttgacggcaccgaataaaagtgcggtggatattttgcaaaaatttgccggtcaatccgttacttttattgcacctgatgagtttgttcaccgtttggtagaaaatccgcaagaatatcaacatgcttggctatttgtagatgaagcagccatgctacctgtcagtaccttaaatttttttagtgcttattttaaacatattgtttttagtacaaccattcatagttacgaaggtacagggcgtggttttggcttaaaatttaagcaacgaattttacaacaacggcgaaaatgtcttgaatttgaattaaaggagccattgcgttggcgtgaggatgacaagttagaaccttttattgatgtgcttttattgcttaatagcgaagatgattttcggcaatatcattacaaatccaatttggacgttcacataaaatcgctaaatcaacaggcgttattgacacaaatagcagatttttacggtctattgtctttagcacattaccgcacttctcctattgatttacgtcgtttattggatgctccaaaacaacgattttatttggcacagacagaaggacatttgcttggtggggtatgggcattagaggaagggggattgtcggatcgaggattgattgcgggaatttgtcgaggagaacgccgtccgaaaggtaatttaggtgcacaattattggcttttcaatatcttaattcacaggcttgtgaattacgttctttacgaatttctcgcattgcacttcaacctaattggcagagaaggggagtagggcgagatttgatagctgctttgaaagtagaaagtaacattgattttttatcagtgagctttggttacagctcggagttggtttctttttggcataagtgcggttttaatttagtgtatttgagtgagtataaagaaagtagcagtggcacatataatgcaatggctatttgtcctttgactttgcgaggcaaagaattttcacaacaatgtatgagtcaattcagacgagattttgttttatcggatcatcctttattgaatgagattataaataatcaaactattgaggtagagttaaatgcctttgatgtatactcattgcaaaaatttgcattttattaccgcactttatcggctgctcgtcctgccttatggagactattgaagatgatagctccctctgaatgtcctgtcttgaggaaatatttttgtggtgaaaaagatttcttgtcttatggcggttatcgacaaggagtgataatttgtcgcaacgaagtaaaagaagtgttgcaaaaatataaaaactttctatgatggagtgatttttatacaggaaggagaatgtgatgccggatcaatcagaaaagaaaggttttttccgccgtatgctggatgcgtacaatcaattttgtaatgaaatggaggtggataaagggacttgtcgaggctgtgtacctatagtcaaatttgatgaaaatgcaaaacaagaaacagataatgaggctggtaaagcatcataattgtgaagtacttcacataatggaaaagatttagccaaccaatgtatccatcttagtttacttaactataacaactctctaaaatacgcacgctttacttcagtgaagttggcgtatttttattattatttttaggtgattattatgttatggtttttcttttgtgttgccctattgattttaggctatttcacatacggtaaatttgttgagaaagtatttgttatcaatccgaacaagaaaacgcccgcttattctatgacagatggtgttgactatgttccgatgtctaaaaagaaaatttggctaattcaattattgaatatcgcaggcacaggtccaattttcggaccgattatgggggcattatatggaccggtggcgatgttatggattgtactgggttgtgtatttgccggtgcagtacatgattatttctgtggtatgttgagcgttcgtaatggcggtgcttcaatgcctactcttgccggacgctatttaggtactcccgttaaagtatttattaacgtacttgccgttgttttattattccttgtcgggattgtgtttgtaaccagtcctgctcagttattaagtactattactttagatatgtttggtagtgcaagtacggctacaaccaatgcacatgaggtggtaagtgcggtacaaaacgctggtgagatccgtgtttggggaatggataaaccgacagttgtggcggtttggactggaattattttcctttactatattgtggcgacattgttaccgattgataagattattgggcgtatttatccattatttggtggactattattattcatgtctgccggtatggtatatggcttagtatccagccatttaaatggtgctgatccaattgaatttttccgttccgttgatggtatgagttttgaaaaattcttacaaaactttgaaactcgtaaagagctaccattatggccattattattcttaaccatttcttgtggtgcactttccggtttccatgcaactcaatctccattgatggcacgttgtgctgaaaatgagaaagaaggtcgttttattttctacggagccatgattgcagaaggtgttattgctttagtttggtgtactgttggtttaagtttctatgaaaatttgggtgaactattagctgcaacccaacaaggttcaccttccaaagtagtgtatgattcttctatttatttcttagggactattggtggtgtttttgctgtattaggggtagttgtgctacctattacttccggagatacagcattccgttccgctcgtttgattattgcggagttcttaaaaattgaacaacgcactttggtgaaacggttacttattgcagttccgttatttgcagtcggtttttggattattgcatcaaaaattgactttggtgtgttgtggcgttatttcacttgggcaaaccaagcaacagcaatggtgatgctatggacagctgcggcttatctatatcgttacaataaattccattgggtgtgtactattccggcagcgtttattagtgcggtatgttttacatacttagcctataacaaaatcggttttggtttagattatcaactttccgtttatattggtattggattaactattttgtgtttagtggctttctttactttattgaaaccgttaggttcgaaagatccggatgcctttataaatgatgtagcataatttataaacaatagataaaaaaccgtttaaggcaacttgaacggtttttttataaaaaatttactttatttatatgttttcaagataaaaaacttgcaacctaatctcactggtaatacacttatgaagtggtaaaaagtggaattttgtggagaaatttgtcacaatcttcctcatttatctgcgaccaataattttttgtgattaaagtaaggaaacaatatgtttcgaggggcatcagcggttaatcttgattctaaggggaggattgcaattcctactcgctatcgtccggaaatcctcgaaataaatcaggggcagatggtttgtaccgttgatattcgccagccttgcttattactttaccctttaaaccaatgggaaattattgagcataaattatcaaaattgtcgaatttcaatccggaagaacgtagtttacaacgagtaatgctaggttatgcaactgaatgtgaacttgacagtgccggacgaattcttattagtgctcctttacgtcaacatgcaaaattagaaaaatccattatgttggtggggcaattaaataaatttgaaatttggagcgagtcagagtggcaagctcaaattgaaaaagatatgacattaggtgcgagtggacaatttgccatgtctgaagcattaagtatgttatccctataataaaaaagatacgttacagtcagtaacggtactagcaaaggtaaaaaggtacgttttttgttgtaccttttatcccttttgattttattgatttttcctaggttattgcaaatgagtatgcaagatacattttcttcacctgagcatttcactgttttattaagagaagcagttggcggtttagccttaaaagaaaatggtatctatattgatgggactttcggtcgaggcggtcattctcgttttatcctttctcaactgtcaaaaaagggtcaattaattgcgattgatcgtgatccccaagcaattcaggttgcacaaaatattcaagatccacgttttcgtattgtgcatgacagcttttcagctattccggatatttgtgaaaaattaggattgacgggcaaaattgatgggattttacttgatcttggcgtgtcatctccgcaacttgataatgcggaaaggggattcagtttcatgaaagatggtcctttggatatgcgtatggatacgacacaaggattatcggcaacggaatggttgaggctggtttctgaacaggatttagcatgggtattgaaaactttcggtgaagaacgctttgccaaacgtatagctcaggcgattgtaggatataacaaaagtgcggtgcaaagtggagcagaacctttaaacagaactttacaattagctgaactgattgctcagtctgtaccttttaaagataagtataagcatcctgcaacgagaagtttccaagctattcgtatttttattaattccgaattagatgaattagaaaaagtattgaatggagctttaaatgttctcgctcctcaaggacgtctgtcgattatcagctttcattctctagaagatcgtatggtaaagcattttatacgtaagcaaagtaaaggtgatgatttgcccaaaggattgccattgcgtgaagagcaaattcaacataatcaaaaattaaaacctgttggtaaagcgattatgccgacagaacaagaaatggctgctaatgtccgttcaagaagtgcggtcttacgcattgcggagagaatataatggtaagagatttcgaacgctacccattgtataaagttatttttgaggacttggtttctgcaaataaattattaattgttttaacgattttggttgtattgagtgcgttaagtacagtttggattactcatcaaactcgtattttagtcgctaaaaaaagtaatttagttgttgaaaatcaatcacttgagcaagaatatttaaatttaagattagaggaaaaggcccatagtcttcattccgatatagagtcttttgccactcaaaagttgaagatgaaatccgttccggctgaacaagaggttgttatcattgaatagataatagatattaggcggttattaatgacacataataagataaatcgaaaaaataaacgagcatttgaaaatggtgcaaagcgtaatcaacctaaaaagatctatgaaaatagtttcttgaaatggcgttttatggttgttgttggtcttattattttatcactcacagctttagtgggacgtgctacttatgtacagatgattaaatccgatgtgctatctaatgaggcggatgaacgatccttgcgtaaagaaaaaattttgtctatgcgaggtaccattgttgatcgcaatgggcaacttttatcagtgagtgttcctatgttttcaatttcagctgaaccaaaaaaaatttttagtaaaaatggtttacaagatgaggaacgctggagtgcattagctaaagcattaggtatgtcttacaaggacttacgaaaaattctagaaaaaaatcctaaatctggttttgtctatttagctcgtcaggtgtcaccaaccattgcggagtatgttaaagaattaaatctatatggagttaacttaaaaactgaacctcgtcgtttttatcctaagacagaggaaactgcacatttactcggctataccaatatagacggggaaggtattgaggggatagagaaaagttttaattcatttttagttggtaaacctggatcaagaacagttcgcaaggataggtatggtaggattattgagaatatatcagatcttaagaaatacgatccgcaaaatgtcattttaagtattgatgaaaaattacagtccgtagcttatcgtgaaataaagaaagctgttgaaaaatacaaggcggaatcaggaacggcagtacttgttgatattcatacgggagaagtgttggctatggctaatgcaccttcttataatccaaatatacgcacaagttttaagactgaagtgatgcgtaatagagctattacagatactttcgagccaggttcgactattaaaccttttgttattctgaccgcacttgaaaaaaaagtagtgcgaagagatgagataatcgacactggtcgtttggttttagatggatatgaagttaaagatgttgcagtcagagatcgtcaaacgcttgatcaaattttagaaaattcgagtaatagaggggtgagccgtttggctttgcgtatgcctgcaaatgcactaatagatacatataaaaaagcaggtttagggcaacgaacagaattaggtttagttggggaacaggcaggtttcttgaatgccgatcgtaagaaatggtcagatattgatagagccagtgtttcctttggttatggcatcagcactacgccgttacaacttgctcgtgcctatgttactttgggcagtttcggtatttatagacctctttcaattacaaaagtagatcctcctgttattgggcagcgagtgttttctgaaaaaatgactcgtgaagtggttaatatgatggagaaagttgcgataaaaaataaaagagcaatggtagagggttatcgagtgggaataaaaacaggaacagcaaagaaaattgaaaatgggaaatatgttaacaaatatattgcttatacagccggacttgctccaatcagcaaccctcgctatgccttagtggtattaattaatgatcctaaaggtagagaatattatggtggggttgtttctgcccctgtattttccaatattatgagttatgctttgaaagcaaataatattcctcctgatagtagtaactatacaaaaactgttagacgtacagtttatctcaatagtcaagagaataaagcgaaagccaattaatcattcaggtaatctatgaaaaaattaaccgcactttgggatattgatgaacaattagatagcgttcatagagatattgaacttcaagaaatgattttagacagccgtttagccaagaccggctgtctttttgttgcgattaaaggacatcgtgttgacggtcgagaatttattatgcaagccattcaaaatggagcaagtgcggtgctgtttgaaactgatctagtggagcagcatttgaaagtaagctttgagcaaaatattccgcttattgcgtattatgaactgtcaaaacatctttctcatattgcagatagattttattcatctccttcacaacgtttaacccttgttggtgtaacgggaaccaatggtaaaacaaccatagctcagttacttgcacagtggacacaaattttagggcatacaagtgcggtcatggggacgattggcaatggtttatttggacaaataaaagaagcttcaaatacaacgggatcggcaatagaaatacaatcctcgttagataaatttattcggcaaggtgctgattttgctgcgattgaagtgtcttctcacgggttagtgcagcatagagttgaggcactgacttttcgtgcaggcatttttaccaacctaagccgtgatcatcttgattatcatcataccatggaaaattacgcacaagcgaagaaacgtttgtttagtgaactgaattgtcaacataaaattttaaatgttgatgatgaaatcggggcaaaatggctgattgaattaagtaaagaggatcctgatgtggttgcagtaagttgccgtgcggattatcaaccaagcacgaaaaattggttaaaagcgaccgcacttagccctcatagtaaaggcacaacgattgagtttgtctcaagttggggaaatgggatcttaagtagcccattaattgggggcttcaatgtgagtaatttattacttgttttagccacactcttatcgcttgggtatgacatagataaattacttgctacagtacggcaattaaccggtgtttgcgggcgaatggaaatgttgagtgcaaaacataaggctaccgtgattgttgattatgcacatacaccggacgctttagagaacgctttgcaatctgctgcagttcattgtcagggaaaactttggtgtattttcggttgtggcggtgatcgtgatagaggtaaacgtccattaatggcagctattgccgaaaaatttgctgatagtgtgattgttactgatgataatcctcgaacagagaatcctgaacaaattatgcaagatattttgacaggttttcagcaatcaagtgcggtgcagattattcatcagcgtgagcaagcaattaaaacagcgttacaacgtgcggtagaaaatgatgttgttttgattgctggaaaaggtcatgagaattatcaaattattggaacaactaaataccatttttcggatcaggaaattgtaaaaaagtatttttaagtttagtaaaatttgaagtcattgatgagtaaaatacagaaataattcattgtattgaatgatgagaagtaagaaataacatgattaagttatcgacaaaagaactggctgacattttttccgcacgattaattggagcgaaggatatttgtgtggaaaaggttagtaccgacacaagaaagccttgtttaagaagtttgttctttgctttgaaaggtgaaaattttgatgctcatgattatctgacacaggcagtagaacaaggttgttcagctgttgtagttgagcgtgagtgtgatgttgatgtaccacagttaattgtacctgatactcgtcttgctttagggcaattagctaaatggctaagagtaaaaattaatccaaaaacaatcgcaataacgggatcttccggcaaaacaactgtcaaagaaatgacagcttctattttgcaaaaagtggcacaagatcctgatgcggtcttatttactcagggcaattttaataatgatatcggtgtgcctttgaccttgttacgtcttgagtcgaagcataagtttgctgttattgagttaggtgcaaatcatcaaggtgaaattgcttataccgtggatttagttcaaccggacgtggcattggttaataatgttgctgcggctcacttagagggatttggaagtgttgaaggggtggcacaggcaaaaggcgaaatctatcaagggttaagtgaaaacggcattgccataatggaatatgagcattctgtgctctggaaaaagtattggtatgaacaaataggtaatgcagatactcgattgttttccgttatggggatggtgtcggattactatgcacaagaaatcaaattaacggaaacaggcagtcagtttacattgtgttgcaccggggaaggagaaattaagattaatctgccttatttaggattacataatgtcagtaatgccgtagcggcagcctcattagctttatgcttaggtgtgagtttagaacaaatcaaagcaggcttagaaaaaaaatcgtatgtaaaagggcgtttatttcccattgagccttgtccaaatctactgttattagatgatacttataatgctaatgtaagttcattgaaatccgctattgatgtattgcgacaatatgataaatttttccgtatttttgctgtcggtgatatggcggaattggggggaaattcagtgagttgtcacaaacaagtagcggattttgctcagatggcgaacttagatttagtggtcagttttggtacacaaagtgcggtcatttccggtgcttgtgatggcgttcattttagtgataaaaccgagttagtgaattatataatccccattattcagcaaaaattagccagtcaaaaagttgttttattagtcaaaggagcgagatgtatgcaaatggaagatgtgattaatttagtaaaggataaatttcaatgttagtgtggttagctgaatatttacaccaatatcaaagtgtatttaatgttttttcttacttgacagtgcgtgcaattcttgcacttttcaccgcacttttactctcgctatggattggtcctaaagtgattcgtcgtttacaaattttgaaatttgggcaagaaatacgtaatgatggtcctgatagtcacttaagcaaaaaaggcaccccaacgatgggcggtattatgattttatttgctataggggtcagtacgttattatgggcaaatttagccaatccttatgtttggttttgcttgtttgtattatttggctatggagcggtcggttttgttgatgattatcgtaaaattacacgcaaaaatactgccggtttagttgctcgttggaaatatttttggctttctgttatcgctttaatctctgctttcggtatgtatgcgataggtaaagatacggatgcgacacggttggttgtgcctttttttaaagatgtcatgcctcagttaggtttgttttatattgtattggcatattttgttattgtgggcaccggcaatgcggttaatttgaccgatgggctggatggcttggctattatgccgacagtttttgttgctgctgcatttgcgttgattgcatgggcgaccggaaatattgaatggtcaaaatatttatatattccctatattaaacatacctctgaattggttatattttgtactgcaattgtgggtgccggtttgggttttttatggttcaatacgtatcctgcacagctttttatgggggatgttggttcattagcattgggtggagtattaggtactattgccgttttagttcgacaagaatttttattggtgattatgggcggtgtatttgtcgttgaaactttatcggttattttgcaagtaggatcttataagttacgcaatggtaaacgtattttccgaatggcaccaatccatcaccattatgagctgaaaggttggccggaaccacgagtaattatccgcttttggattatttcgctgatgttagtgttacttggattaattaccttgaaattacgttaaggcaagctatgactaatcaatatcaaaacaaaaatatctgcgtagtcggattaggtaaaacaggattgtcttgcgttgatttcttgttacggcagcaagcaaatgtacgtgtcattgatactcgtcaacagccgacgggagcagaaaaattacctgaaaatgtccccttacatacaggaagcttaaaccaacaatggctacttgaagctgatctcattgtgattagccctgggctttctgttaaaacacttgaaattcagaccgcacttcaggccggtgtagaggttgtcggtgatattgaattattttgtcgttacgccaataagccaattattgctattacaggctcaaatggtaagagtaccgtgactacattggtcagtgaaatggcgaaagaggatggcttaaaagttggaatggggggaaatattggtattcctgcccttgagttattgcaacaagattatgatctctatgttttagagctatcaagttttcaactggagacgacttatagtttgaaagcgacagccgcaacgattttaaatattagtgaagatcatatggatcgttatctcgatattgaagattatcgccaagccaaattgagaatttatgaaaattgtcaacgtgcggtaataaatgccgaagatgtattaacaacaacggaagatttaaagtctccaattacttttggagaaagtcaggctgattattggctaaaaacggaaaatggtaagcaatatttaatggcaaaagagcggttaattttaccttgtgatgaaatgaaattggtaggtcgtcataattatatgaatgcgttggcggccagtgcgttggttcaggctgtcgacataagttttactgcaattcggaccgcacttcgtaaatttaccggtttagctcatcgctttcagttagcatatcagaaagatgatgtacgttggattaatgattcgaaggcaaccaatgttggaagtacagttgctgcactgaccggtttgtatgtagctaataaattacatttattgttggggggggatggtaaatccgcagatttttcggaattggcaacattaattaatcaaccccatatttattgctattgttttgggcaagatggtaaagaacttgccgcactatcagtgcaaagtcagttatttgatacgatggaacaggcaatagaagctattcgtccgaatttacagcaaggtgatatggtgcttttatcaccggcttgtgcaagtttggatcaatttaaatcctttgaacatcgaggtgatgtttttagtgatttagcgaagttggcacagggttaaagatagagacaaaatgggacaaaataacgtaaaacaacatattgatcgttggttgcgtattacaccaacaacagcattatatgatcgagcattgctatggttgtttattattctattgtgcttgggattaattagtgtatcttccgcatctattccaatcagtacaagattatttaatgaacctttttactttataaaacgtgatataggatatatttttatctcgttaattgcttttgcgtttgttgttctcataccaatgagaatgtggcaaaaatataacgttatattattttggattgctgtgattttattattgctggtgcttactggaatcggaaaagatgcaaacggtgcaaaacgttggattccgttacaactatttaattttcaaccagctgaatttgccaaattagcactaacgtgttatttggcagattatttcacacgccgttataatgatgtacgtagcaaaaaattaagtgcatttaagccattttttgtcatggctatattgggtggattattattgttacagcctgatttagggagtgcggttgttttatttgttataacttttggcttgctttttattgtcggtgcaaatttttggcagtttgtagggttgggaggaatcgcttttttcttattcctatggttagtcgcatctgcctcttatcgtttaaaacgctttacaggttttcttgagccttttaaagatcctctaggagcaggttaccaattaacaaattctttaatggcttttgggcgaggtgagttatggggcgaaggattgggaaactctgtacaaaaattggaatatttgcctgaggcacataccgattttgtcatggcgattgtcggtgaggaatttgggcttgtgggcattattgtggtggtgttcttacttgcgttactcgtttttagagtaatgaaaatagggagagagtcattattattagaagaacgctttaaagggtttttggcttttggtataggtttttggatattttttcaaggatttgtaaatctcggtatggcattaggcatgttaccgaccaaaggattaacctttccattagtgagttatggcggttcaagcttgctgattatgtcagtcagtattgcaattttgttgcggatagattacgaaaatagagttgttcgagttggaagtgctcgactaagagatgattaaaataaggaaaataccgtgtcaaaaagaaaaaaattattggttatggctggcggaaccggaggtcatgttttccctgctattgctgttgcacaatatttacaaaagcaagattgggatatttgttggttaggcactcgggaccgtatggaagcaaagttggtgccaaagcacgggattccaattgagtttattcagatttccggtttaagaggcaagggattaataactttattgaaagcaccttttgtcattttaagagcggttctacaagcgagaaaaatcataaagaaatatcaaccggatgtagtactcggcatgggaggatatgtctctggaccaggtggagttgccgcaaaactttgtaacatacctgtagttgtgcatgaacaaaatgctgtattaggtttaacgaattcattgctggctaaaattgcgacacgggtattacaagcatttccaaatacatttcctaacgcagaagttgttggtaatccggtgcgtgaggcgtttttttctgtgcctatgccacaagaacgttttgatactgcttgtgagacactcaaagttttagtggttggaggaagtcaaggggctcatatattgaatacaatattaccggaagtattagctcaattgcctaatcgtctggaaattgttcaccaagtcggggctggttcggtggaaaacgtcaccgcactttatcatgataaagttaatcttacgcaagaatcagtacaaattaccgaatttattgatgatatagctcaggcttatgcttgggcggatatcgtcatctgccgttccggagcattgactgtctgtgaacttgcagctgttggtacaccggctatttttgtaccctttcaacataaagataaacaacaatatttaaatgcaaaatatttagctgatgttggagctgcctatattgttgaacaacatgaattggatgcagaaaaaatagctcaattattaaaaaatgtagataaagaaaaattactggaaatggcggaaaaagcaaaaaatatgtcgacgccgttatccactcaacgtgttgctgaagttataatggatactgttaaaacttagccaattaaaatgaaaagaacattttgctatgtaaatgaataaaggaatgatgaatgcaagcatttagacaacgaattagacaaactgtacctgaaatgcgtcgagtaaaacaaattcattttgttgggattggcggagccggtatgggaggaatagcggaagtgttattaaatgaaggttatcaagtaaccggttcagatattgcggaaagtgcggtaaccagtcgcttaatttctttgggagctaaaatttctttctctcatcatgcagaaaatatagagggtgctagcgttgtcgttgtttccagtgcgattaagggagataacattgaagttattacagcacatgaaaaacgtataccggttattcaacgtgcacaaatgctggcagaaattatgcgttttcgtcacggaattgctattgcgggaacacatggtaaaacgactactacagcaatggttgcaatgatttatgcacaagccggtttagatcctacttttgttaacggcggtttggttaagtctgctggaacaaatgcgtatttaggatgcagtcgttatttaattgcagaagcagatgaaagcgatgcgtcctttttacatttgcagccaatggtgtcggtagtgaccaatattgagcctgaacatatggaaacttatcatggcgattttgaagaaatgaaacaaacttatgtgaatttcttgcgtaatttgccgttttatgggttatctgtgatgtgtgctgatgatcccgttttaatggaattatcctctcaagtaggacgccaagtggttacttacgggttcagtgatgaggcggactatcgcatagaagattatcaacaaacgggttttcaggggcattatacggttgtagcaccgaatggggagcgtattgatgtgttgttaaatgtgccgggtaaacataatgctttaaatgcaaccgccgcattaaccgttgctaaagaagaaggaatcgaaaatgaggcgattctgaccgcacttgccgagtttcaaggtgccggtcgtcgttttgatcaattagggcaatttattcgtccaaatgggaaagtgatgttagttgatgattatggtcatcaccctactgaagttaacgtaaccattcaggcagctcgtcaaggctgggagaataaacgtattgttatgattttccaacctcatcgttattctcgtacccgagatttatttgatgattttgtacaggttttatcgcaagttgatgtgttaattatgctggatgtttatgcggcgggtgaacaggctatcgccggtgctgatagtcgctctttgtgtcgttcaatccgtaatttaggtaaagttgatccgattttagtctccgatcataagcaattagctgaaattgttgatcaggttattcaagatggtgatttaattttggcacaaggtgccggtaatgtgagtaaactttctcgtgaattagcgttagcttggagtaaagaatagtgattagcacttcggagttacaatgtaaaaaagcaggatataaaatgactaaaccattgaaacaacaaaaaatcgccgtcttattagggggaacttcagctgaacgtgaagtgtcgttaaactcaggaaatgcggtcttaacagcgttacgtaatcagggttttgatgctcacccaatcgatccaaaagaatatccagttgctatgttgaaagaacagggctttgatcgagttttcaatattttacatgggcgtggcggtgaagatggtacgatacaaggattattagagcaaataggcttaccctatacgggttgtggcgtgatggcatctgctttaacaatggataaaatgcggactaaaatgttgtggaaagcattcgggttacctgttgcagatatggaagtcgttactcgcactagtttttcgcagttaaatccgcaagtagttgtagaaaaattgggcttgcctttaatggttaaaccttctttggaaggttcaagtgtcggattgacaaaagttaacgctattgatgatctaaaaagtgcggtggaatttgcacttcaatatgatgaaaccgtactgattgaagaatggctttccggtgatgaattaacggttccgatattaggtaacgaagttttaccttcgattaaaattgtaccccaaggggaattttatgattatgaagcaaaatatattgccgataatacgcagtatttttgcccctcaggattaacggaagagcgtgaacaagagcttcgtcaattagtcaaacaagcttatgatgtcgtgggttgcaggggatggagccgtattgatgtcatgctggacggcgagggtaaattccgcttagtggaagtcaatacaaatccgggaatgacaagtcatagcttatttccaaaatcagctgcaactgttggttattctttcgagcaattggtcgtcaaaattttggagctaagtctttaaatgagaacaacgcataaagtaactgaaaatttgaaagtgacaaaacggaagtcctaccgatttgtcaacattaaatttattgttatgttgttattggttgcaatactgatttttattgttagtaatcgtcagtcgattttagaaaagttagatgatagctcaattaattcatttgctattgcaggtataacaaattttactgatgacaatgatgttcgtgaagttttgtctcgaatatcggacagcggtgagttaaaaggtttttttggacaagatattgatttggttaaacagcaaattgaaatgataccttgggttaaatcagtggcagtacgtaaaatttggctcaatcgcttaagtatttgggtaacggagcatttacccattgcacgttggaatgaaacagaatttttgtcatcagagggaataatatttcaattaccaattagcaaattaaaaatacaaggattacctcatttgtcaggacctgatcataaaagtgctgaggtactggaagcttggaataaaatttatcttgatttgaagagaaaaaatttgttgttaaaaaaaattgctatcaatgagcgtggttcatggcaaattgtgttagagaacgatgttgtattaaaattaggacgtggagaatggaaagataaattggatcgttttttcacagtttatccacagattgaaatacctgaaaataaaaagttatcttatgttgatttaagatatggtgttggtgctgctatcggtgtagtagattctgactaaatttaattttaaatatgtgaagtgactaaaatggctagaattgtagaagataagatatttgtaggtttagaagtaggaacctcaaaagttgttgctgtagtaggggaattattacccgatggcgttgtcaatgtattaggtgccggaagctgtccttctaaaggtattgataaggggagcattacagatttaaatgcggtcgtaacttctattcaacgagcaattgattcaaccgaagcggttgcagatagtcagatatttagtgtgacattggctattaccggtgagcatattcaaagtttgaatgaaaatggatttgtgcctattgctgaggaagaggtgactcaagaggaagttgaagcggcgttgcatacggcgagttcagtccgtattggagatgggctggcattattacatataattccccaagaatttgcagtggataagcaagtaaatataaaagatccactaggattgcaaggtgtgcgtttaagtgctcaagcacatttaattgcttgtcatcaagattggctaaataatctgaaaaaagcggttgaacgttgtaaattaaaagtgaacaaagttgtttattccggatatgcttcatctcaagcggtgttgactgaagatgaaaaagaattaggtgtttgcttaattgattttggtgccggtacgatggatattgtggtttataccaatggttttattcgctttagtaaggttattccttatgcgggtaatcgagtgactgacgatattgcttatgcttgtgcgacttctaggacagaggcggaaagtattaaagttgcttatggaagtgcggtcagtcctccattagatcctttagataaaaaaattgaagttgccagtatcggtgggagagcacctcgagttatcagcaaagaacaactttcaattattacttctgctaggtatgcggaattacttggtgtagttaaatctgaattggatcaattgaaatatcaattagaaagtaaacagataaaatttgaacttattgctggaattgttattactggtggcggagctcaaattgaaggattaagagaatgtgcaacgcaagtattcggttctcaagtgaggattggtgtcccacttaatattaccggtttaactgattatgtaaataaaccacaatattcaaccgtagttggtttattacatcatcataataatgattttgaggatattttatctgaaagtgaaacagaaactgacggtgtcggcaaaaaattttggaatatttgtaagaaagttgtcaataaagtgcggtcagaattttgaaaaattgattttttaatctacaataggcagaatttaagttttaattttgtgctaaagtcgggaattagcatttacggagaagaaatatgattgaaccggttgattacgattacgatgatattagcggaggtgcactcatcaaagtcgttggcgttggtggcggtggcggtaatgctgttaaccatatggtggctaatatgattcaaaacgatattggcgggacgctacttggcgttgatgaattggcttatccaatgtcagatgataatcatggcaaaattattttctatgctgtgaacactgatgctcaggctttgcgtaaaagtaatgtacaaaaaacagttcaaatcggtggtgaaacaacaaaaggcttaggtgcgggagctaatcctaatgtaggacgtaaggcagccgaggacgatcaggatgctattcgtgctatgttagaaggtgcagatatggtttttattgcagccggcatgggtggcggaacaggaacaggtgcagcacctattgttgcacaaattgcaaaagagctaggtattcttacggttgctgttgtcacaaaacctttctcttttgaaggtaaaaagcgtatgcattttgccgaattaggaatcaaagaattatctaaacatgtagattccctgattattattcctaatgaaaaattattaaaagtacttggcaaaaatatcagtttaattaatgcttttgctgccgcaaatgatatattgcgtaatgcggttactggaatatccgatatgattacttctccgggactaattaacgtggactttgctgatgtgcgtactgttatgtctgagatgggtcgtgcaatgatgggatccggtgttgttcaaggcacagcagctgatggtcgtgcagaaaaagcagcacaagaggctgttgccagtccgttgttggaagatgttgatttatccggtgctagaggtgttttagttaatgttactgcgggattcgatttaactttagatgagttttcaacagtaggtgagactatccgttcatttgcatctgaagaggctaccgtggtggttggtacaacgttggttcctgaaatgtcagatgaaattagggtaactattgttgcaacaggaattggggacattgaaagacaagatgttcagattatgtcaacatctccaatgaatgagcccgtaaaacctgttgaacagcagcatattcgtccagaacctagacatgatttagatacaccgattacagagagattaaaagcatttagacccgtagacccaacaagtttctctcgtgactaacagagttcatcttgttgtttagcaataaggttaaagaaagatgattaaacaaagaacattaaaacaaagtataaaagttaccggagttggcttacatagtgggaataaagtgacattaactttacgccctgcgatgccaaatacaggcgtaatatattgtcgaaccgatatgaacccgccggttacttttccggcaaatgcaaatgcggtacgtgatactatgctttgtacatgcttaatcaacgaggatggggttcggatctctacggttgagcatttgaacgctgctttagctggattaggtattgataatattattattgaggttgatgcacctgaaattccgattatggatggaagtgcgagtccatttatttatttgttattagatgctggtattgaagaacaaaatgtagcgaagaaatttattcgtgttaagaagccaattcgtatagaagacggtgataaatgggctgaatttaaaccttatgatggcttccgtttagatttcacaattgattttgaacatcctgcaattggtaaagatgtacgtaattatgtgatggatttttctgctcaagcttttgtacagcaaattagtcgtgcaagaactttcggttttatgaaagatattgaatacttacaatcccaaggtcttgctttaggtggaagtttagataacgctatcgttttagatgattatcgaattttaaatgaagacggtttacgctttaaagatgagttggttcgccacaaaatgcttgatgcgattggagatctttacatgtgcggttataatattatcggtgattttaaagcctataagtccggtcatggattgaataataagcttttgagagcattacttgaaaatcaagaagcgtgggaattcgtaagctttgaagataaagaagaaatcccgcaaggttatgtttctcctgcacaggtttttatctgaattagtgttgtaagataaaagctatatttccagcgaagtatagctttttttatagctatagtttttgcttttacatattacttaccagcatagaaaaatattcaagttattataggatgttatatgtcattagatttaagcgaaattcgtcaacaaattacacaaattgaccgcagtttattaaagctgctctcagagcgtcatcgtttagcatttgatgttgtacgcagtaaagaaattacacagaaagcattgcgtgatgttcaacgtgagcaacaattattgaaagagttggtgcaatttgcggataatgaaaattatcaattggaaccacaatatattactcaaattttccaaaaaattatcgaggactccgtattaactcagcaagtatatttacaaaagaaattgaatgagcaaagagagaagaatattcatattgcttttttaggtaaaagaggttcttactcgcatttagccgccagaaattatgcaactcgttatcaggagcaactaattgagctaagttgtgcgtcttttgatgaagtattttcctctgtgcaaaatgaggaggcaaattatggcattttaccgttggagaatacaacctcaggagcgattaatgaagtgtatgatttattacagcatacagatctttctttagtaggtgaattggcttatccaattaaacattgtgttctggtaaatgctcaagatgatttggataagattgatactttatacagtcatcctcaagtgattcagcaatgtagccaatttattcgtactttaaagcgagttcatattgaatattgtgaaagcagctcacatgcaatgcagcttgttgccagcttaaataaacctaatattgcggctttaggcaatgaagacggtgggaatttgtatggtttaaaagtactaaagtcaggcatagcaaaccaagaaaacaatattacgcgatttattgttcttgctaagcatccgatcgcagtatcaccgcaaattcatacaaagaccttattgttaatgagtactgctcagaaagtgggtgccttagttgatgctttattggtcttcaaaaaatataacatcaatatgacgaagttagagtcacgtccaatttatggtaaaccatgggaagagatgttttatttagaaattgaggctaatattaataaccctatcgctcagcaagcttttactgaactaaaagcattcagtaactacttgaaaatcttaggttgttatccaagtgaaattgtgaaacctgccgaagtctaataaaaagtgcggtctaaatcaaaaaaatcccctttattgaaaaaggggattaggcgttgatttattttttcggtgcaagcaaatcaggttcttgaggtttcgctacattttcaaaagatttattttgattcgcttgaataaggctgtctgcttgttgagccaattttgttagccccattttttcgtaagcatttttcatcaatggcaacgcatcaagagtagcttttgtgtcaggatattgttgtaacatacccactacacgatttgctacagcaacatgagcattgcgttttgcatagaatttagcaatttccaattcatgacgagcgaggcttgctctaatataagccatacgtgctaaagcatccgacgcataagagccatttgggaaatgctgaactaacgtttggaagttagcaaatgcagttttgatagacgtactttcacgtgtcgcacgatctacaccaaaaaggtcttggaaccagttatcacctaatgctgaattgcttaaacctgctatataaatgacataatctaaatgcgagctttgcgggtattgttgaataaagcgatcaattgttactaaagcattagtgtagtcttgagatttatagtaagcataaattagatccaattgtacttgttcattatattggcttccggggaagcgtttttttgccgtgtctaaataacgaattgcttggctataatctgcgtcttgtagatagctgtgtcctttttcataaagagtttgtgctgttccttcttcaatagctttacctgagcttgaacacgcaccaagagcaaggcttgcaaaagcgactaaagcgagagatttcaatttatgcatgagtgaatccttatttttacaatcaataataaatgttacaataattcgttattttatagcacattgctaaataagcaaattatctgatggattttttattatgacacaagtgatattgtcagccgatattcagccccaacatatgggacaacgcttagaccaaacgttagcagaattgttcccggattattcccgctctcgtttgaaaacatggattgagggtgatttagttaaagttaatggcgaaattattaatgttgctcgtacaaaagtttacggtggtgagttagtggaactttgtgtggaaattgaagaagaaagcaggtttgaacctgaaaatttaccactcaatattgtttatgaggatgagcatattttagttattaataaaccaaaagattttgttgtccatcccggtgcagggaatcaaagaggaactgtattaaatgcactgttgtatcattatccaaaaatagtagaagtgccaagagcgggcatagttcatcgtttggataaagatacgacaggtttaatggttgttgcaaagacaattccggcacaaacaaaattggtacaggatttacaaaaacgtaaaattatacgtgaatacgaagcagttgcttttggtgtgatgacacaaggtggaaaagtagatcaacccatgtccagacatccgacaaaacgtactcaaatggcggttcatccgttgggaaaaccggcggtaactcattatcgtataatggaacgtttccgcaattatactcgcttacgccttcgtttggaaacaggacgcactcatcaaattcgagtgcatatggcacatatttcccatcatttactaggcgatcaaacttatggaggtcgtcctcgtccaccgaaaaatgcaagtgaagaatttatgcaagtgatgcgtgattttaaacgtcaagcgttgcatgcaattatgctccgcttaactcatcccattacaggcgaaataatggaatgggaggctcctttgcctgatgactttgtaacattaatcaatgccttaaaagcagattatcaattacataaagatgaattagattattagtatgcaaataataaaagcgaatctcggtcaagtagcgaatgttcaagggctaatgacaactcggcaaggcggtataagtgttgcaccttatgacagcttaaacttgggtgatcatgtcggtgatgatgaaagtgcggttaaaattaaccgcactttgttagtgaaagaattaggcttaccgcaagatcctatttttcttaaccaaacgcatagtacaaaagttctgcgacttccttatcaagaaggcatggatttaaatgcagatgcagtttatagtgatcaagctaaccaagtttgtttggtgatgacggcagattgtttgccagtactttttactaatagacaaggcaatgaagttgctgctgctcatgccggttggcgaggattatgcgacggtattttagaagaaaccgttaagcaatttcgtgttcccaaagaagatattatagcttggctaggtgttgctatcggccctaagttttttcaggtcggtaaagaggttgttgagcaatttatagcaaaagatcctcaagctaaaaatgcctttacgccagatcgggaacaggaaaataaatttctgggtaatctgtatcaaatcgccaaacagcgtctaaatgctttgggaattacagaaatttacggcggagaacattgtacatatagcgataaagagcggttcttttcttatcgtcgtgatggtaagacaggtcgattggcttcattgatctggttttccaagtaaaaaagagcggttagttgtattgagtatctaaccgcttaacagggaatagttattatccttcgaagccgtcaaacaaggctgtgcttaaatatcgttctgatgcagaaggtaagataacaacaatgagtttatcggaaaattccggacgttgtgcaattcgatcggctacagcgagtgctgcaccggatgagatccctccgagaataccttcttctgccattagacgacgagccgttataatcgctgtttcactactgactttttctacttgatctactaaagataaatctaagtttttcggaatgaaccccgcaccaataccttgaattttatgtggccccggtttggtttcttcacctgccagcgtttgagttatcactggtgattcttcaggttcaacggctacggtaataattttttttccttgatcttgcttaatgtaacggctaattccactaattgttccgccagtaccaacaccagctaccaatacatcaattttaccttcagtgcctgaccaaatttcaggtcctgttgtttgttgatgaatggctggatttgcagggttttcaaactgttttagcattacatagtgatttggatttgaagcaacaatttcttccgctttagcaatagcccccttcataccattgacaccttcagtcaacactaaatttacccctaaacctcgcaataagcgtttacgttcggaactcatagtctccggcatagttaacgtgattttatagccacgtgctgcagcaacataagctaaagcaatacctgtattaccactagttgcatcaataatttctttatctttggttaaaataccatctttttctgcttgccataccatattggcaccaatgcggcatttcacgctaaagctggggtttctcccttcaattttcgctataatgttgccgttattaccaaagttttttaaacgaactaatggtgtattaccaatagaataggaattatctgcataaattgtcattattttctcctaagagttgtgagttgtattttttacagtatttttatcatagctttatgaattgcaaaatagcaaaacattctattttataactaaacgctatttcacaatcgtggttttaatccgtatgaggtttgttaatgtcgttcttaccggcataacgatattgttcaacccacatagctgttgcaccacagacagcaacaggaataatcagcaaattaatgagcggaataaatgtacataaagtcaccaaagtaccaaaagttaacgttaatgtatgtttctgtccaagttccgttttcatacgttgaaaaggcactttatggttatcaaaaggatagtcgcaatattgaatagtcatcatccatacagtaaacaaaaatgctaaaattggaataatgctttgtccaataaatggaatgaaactaagtagagatagagcaataattcgaggtaagctataagtcaatttttgcaattctcgttttagcattcttggaatatcttttagaaaatctaccgcacttccttcagtcggactttctcccgttaacattttttccactttttcagcgagcaaggcattaaaaggtgcggcaataaatccagagagtgttgtaaacataaaataaaaaatgcttaacaacataagtacagctaagatgagcagaatcatacttaaccagctaagccaatcgggaataaacgtgatcatgctctcgagccaagtactgaatcggtttataaacaaccataacagccccgataaaagaagaatgttaagcaaaatcggcataacgacaaaacgacgcaaaccacgttgtctaatcaaatcccaacccataataaagtaatgaaaagctttttttatctctgttagttttaacataaattttccttaattgaaaaaacacacttatcaaacgacataataccgcagaattcaagtagggtaaaaaatctgtattttccatattaatcaacaagtaaaatatgataagctagcaaaaatttgctgttcgatgaagctaagtaggagaacaagataatggatttaaatgctattttaattattttaggtgtaatcgcattaataattttagttgcacatggcatatggtctaatcgccgcgaaaaatcgcagtattttgaaaattcaaaaaactttactcgagaggcacgtatccgtgaaccacaagaaaatcagcaatatcaaaccgctgatcaatctcagtcggattttcaacgtaatttgcttgaaactgataatgactgtttttctagtgaatcagcacataattctcaccaacctctttatcattatagtgagcaaagtgcggtacaatctgttgatcaaattaaaattaggttgcctgacagtgagcctaactatgtaatgcaagaacagttctcaccgaagcataccgactacgcctccatgagcattgaagaactggaaaaatcaattgatcttgatgagggaattaattcatcttctcaacatttacgccaagagctagctcaaatttcagggaaatcaatagctgatgataaggtcaatatagaagagcatatgtttactgaaagcagcatatcttttgtagaaccacagacaaacgcggaatcccaacaggttgctgaaaaaacaaaatcaggtaattcttcttttatcatgctttatgtggttgcctctgaaaatcaaggttttagcggtttgcaattgactaaaacacttgatgagctaggatttatttttggtaaaaaacagatttatcatcgtcatgtggacttaagtattacaagccctgttttgtttagtgtggcaaatattgaacagcccggtacgtttgatttaacaaacattgcagatttttacacggttggaattgcattatttatgcaactgccttcttatggtaatgctacagccaatttacgaatgatgattagagcggcaaaaaccatcgctcaagatttagacggtgttgttgtaacagagcaacaagaaatttttgatgaacaggctgaaagggattatttggctcgtgtttcttgagtggcaaaatttgggaaatattgaccgcactttatgcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccataaaatatgatttatatcaataaagtattcaatgttggttgagtttgtaggctaaaattttgtagtatatgcaccatcaagtgattgcttgatgttcataaagttcctaaataaaataatcataatatagcaaaactgctttgtgacctccctcttgggaggtttttttaattaattacaaagttggaagtttaacgtttctttgactgataaactgttcttttcctgtatgtctatggcactaagtccttactcgctaaatttctacgttcaattcgctaaatcctataatttcaagtaaaataaccgcactttttacatcatagagagaatatatgtcatcacaatttgtttatactatgcacagagtaggtaaagtagttccgccgaaacgtcatattttaaaagatatttctttaagtttctttcccggtgcaaaaatcggagtgcttggcttaaatggtgccggtaaatctaccttattacgtattatggctggaattgataaggatattgagggagaagctcgcccacaacctggtattaaaattggttatttgccacaagaacctaagcttgaacctcaacaaaccgttcgagagaccattgaggaagctgtcactgaggtaaaaaatgcgttagttcgcttagatgaggtttatgcattatatgcagatcctgaagcagactttgataaattagcaaccgaacaggcaaatcttgaggcgattattcaagctcatgatggacataatttagaaaatcaattagaacgtgcggcagacgccttacgtttaccggattggaatgccaagatagaacatctatcaggcggtgagcgtcgtcgtgtagcactttgccgtctattacttgaaaaaccggatatgttgttacttgatgaacccactaaccacttagatgcggaatccgtggcttggctagaacgtttcttacatgattatgaggggaccgttgtggcaatcacccatgatagatacttcttagataatgtggcaggctggattttagagcttgaccgaggagagggtattccttgggaaggcaattactcctcttggttagaacagaaagagaaacgtttagctcaagagcaagctacagagtccgctcgtcaaaaatctattgaaaaggaattggaatgggttcggcaaaatcctaaaggtcgtcaagctaaaagcaaagctcgcatggcacgctttgaagagcttaactcaagcgaatatcaaaaacgcaacgaaactaacgaactcttcattccacccggtccacgtttgggtgataaagttattgaagtgcagaatctgaccaaatcttatggcgaccgcactttaattgataatctttctttcagtattccaaaaggggcgattgtggggattatcggagcaaatggtgctgggaaatccactttattccgtatgctttcaggacaggaacaggcagattctggctctattactttaggtgaaaccgtggtaatggcatcggttgatcaatttcgtgatgcgatggatgacaaaaaaacggtttgggaagaagtttccggcggcttggatattatgaaaatcggtaattttgaaatcccaagccgtgcttacgttggacgtttcaacttcaaaggcgttgatcaacaaaaacgtgtcggtgaattatccggtggtgagcgtgggcgtttacatttagccaaacttctacaagtgggcggaaacgtattactattggatgaaccaaccaatgacctagatgtagaaacgttacgtgcattagaaaatgcgatattggaatttccgggttgtgccatggttatatcccatgaccgttggttcttagatcgtattgctacccacattctcgattatggtgatgaaggtaaagttactttctacgaaggtaactttaccgactatgaagaatggaagaagaaaactttcggtgcagaagcaactcagccacatcgtattaagtataaacgtattgcaaaataattctttgtataaagggaaatattatgaaaaaaatcattaccgtattatcagttttagctgtatctgcttgtgtttcaacagagctatcgacacaaaataagacatataacaatttacaagatgcacgtatccgtttatatgggcaaaatcgtcgtccctcatcaatggaaattgaaattaatggcaagactgaaaaaatcaccgttggaggtggtttgggacaggcttttggttcaatgcttggagttaaagggaatgaaagcattggtatgcctgaaactgaacttagcaaagatccttctgctcattcaaaactactttcggctatcttctttaaagaattcgttataccggcaggtaaagaagtaaaagttactaacagtattcatgacgtaacgaatatgggagaatattatacctcaacacatagaataaccaccactacaacatttaaagggtgtaacggtgatgtcattacttttattgcagaagcaggaaaagattatgaagtggctcctattagctctaatagagaatgtggtgtaactgtttacgagatcaaataattttatcagaagcccattataaactgtctataaagtaaccgcactttaagtgcggttcttttatgttgcgtgattatggcaggctcaatatcagcaataggatattcacttttaccggaaaaatcattgaaaattaacaatgacaacataaagctttctagatgaaatcagcacagaagagttgccccgaaggcactaaaaagattagcgaccgtatgtgttgaacaagaactttgccgagcttttatctgagaaagtcaaacagctcgtcgtactgtgctgtttgttgctaaaagtgttggttttattggaaacctaacctagtcataaaactctgtaaaactgtttgcggatctaaaaatattgaagaaaacaaccgcacttattggattaaagtgcggtaagtatttagctcaaattagaagcagtgataagacgttgtgtataagcatttttaggttgagtaaatacctgctcggttgtacctgtttcgacaacctcacctttactcatcacaataacattatcgcttagtgcttttactacagataagtcatgactaataaaaatatagctcaagccatattttcgttgtagtttattgagtaattcgatgacggtaatttgtgttgaacgatcgagtgcagaagtcggctcgtccagcagaacaaatttcggttcaagaataatcgcacgggcaatagcaatgcgttgtcgctgtccgcctgaaaactcatgagggtaacgattaatcatagagggagaaagattaacttcctccaacatattcatgactttttgtcgcctctcttgtttactcatgtgcgggcaatgcacagtaagaccttctgcaataattttatggggtagtaacaatatttgcataaagtaaaagaaaaatttgggtcggaaaaagttaggtgagggcttgtggttattgggtttgttgaggttggggcgttggttttatgcaaaatagggaaatgagcaggaatggtaaaaaatgggtaaaaattggattattttttgcataaaagtgatcagggtttagatggtttttaaaagatttttaaaacaggtttaaaactctaaaaatggtagtaaaaactaggcaaggcgatttcaggtgaaatcgcctttatttttttggggggaaatcttgtggttttggtgcgtttaggtgaaatctgacttatttttgtgagggattatgcctaaaaatcacgatagccacgcactacttgcccaataacgataaggctatttgcttcttcagcttctagctttaatgggcggtatgttgggttatcgctaattaactctaccccatcataggttaactgcacttttttcactagcattgacccatcattatttaaaacaaatattttcccatcaactaaattacgtttagagcgatccacaatgatttcttcaccatcttttaaggttggatacatactttcaccgctcaccaaaaaacattgcacagttttcagcctttaagtgctttgtttgtagccaaacaagttctacttttatcatctgtgagaactacacagtaaatttatttaactgtgtagttagtaccaattttttataaagtaaacagaatacataaaagaacaatataatcaatgtgttataaattttaggcgttttttttcggatttctttttgtgtagtctaataactctttttctgtgtattcagctaaacgcatattagcgattgaatgcttacaacacattttggctgtttcggagattaactgcttaccttgagtatcacttcttctaaaatttgccagtaactttatttcatccatattcagtaaaactggatttattgcatcagaaggcgtgattagtgaagggttaattgtggcagaataatcatccatatctatttcagttgctttatctttaatggcgttcacaagatcctcattattagcattatttggttctctaatcccagatagaatgtaattgatatccagttttaaatctggacgctcaagctctaatagtcttaaggcattttcaggaaatacacctctacgctttctttcagcaaaggcactttttgacatttttaaaagttcagccacctctttatccatcgttaatgatagttcagtttttaatcgattggcgatgtctgtgaaatttttcataaaaaacctcttgaaattcataaaaatcatatttaatatgaactcagtaaacaataatgaactttatgatttcatattaattcgtattgttcttattctagttcaaaatatgtttttagtccatagaggagtttatatgaaaaaaagaacgagagatgaagctaaaaattggttcagagaaatgaatgtaacgcaatctgaatgggggcgaagaaatggttatagctctaatgaaattagccgagtattgacgggaaaatcaaaatgcctttatggaagagaacgagaaattgctattaaactcaatatagctttagaaagttagaggttcatatgtgtgaactaaagccatactattctgctcaagagttaataggtttacagctagtaatcttaccaacgaccaaaaaagcagtaatagacaaagccaaacgcgaaaattggcaatctcgtaaacgtgttggtcgtggcggtggtgttgaatacgccctttcctctctccctcaagaggtgcaagaggaaatcagagataaatttgcgacctcggttgtggcgggcaagcctaaaaagttgccagtgttgaaatcggtcgtgttggaagacctcaccgaaaaacaacgccaagcggcagatgcaagaatgacgttagtggcttatatcttgcagttggagcaagcacaacctcgttataaagcggtgaagtttttttgccagcaggcgaaacaaaatttgttatcacctgaattaatggcattagtggctaaggcgaataacaaaaaaggtgaaagccgtgtgattggtgaacgcaccttaaatcaatgggtgttggattatgaaaaagcgagcaccccagaagaacgtttaaaagctcttgcccctatgcaacgggtggcaaaaaaggcagaagacatttcgtggttgcctgattttctagcggaataccgccaaaccaatggcattaatgtggcagaagcctatgggtattttgctcaacattggcgagagcgttttgaggatcaacccttaatgcttgagatgttgccaagtcttaatcgtgtcagaagagcgttagccaaattgcctcgccatattaaagaaattgggcgtaaaacggggtcagagcttcgggcattaaacacttatgtgaagcgggattggtcgaaattgttggtaaatgacatctgggtaggcgatggacacagtatgaaaatgaaagtggctcaccctgaacacggtagcccttttatccctgaaatcacgctgattatggacgccccttgtcgttacattgtgggttggtcggcaagtctgtcagaaaatgcccttgcggtggcagatgcgttacgcaatgggatcgaacagcacggtatccctgcgatttattactccgataacgggggcggtgagaaaaactggctacttgatggggatattacagggatgttgccccgtttaggcatcaatcaccaaacagggataccgggcaacccacaagggcgtgggattattgagcgggtacaccaaacgattttataccgcattgcacgccaatttgaaacctatcacggcagcggtgctgatagggaaacggtgagaaaggttagcactggcgtggtatcccttgaaaaagccttgcgaaaaggcactgcacttgaagatttaaccccgaaacaacgcggggctatggggaagttacccagttggaatcagtttttagatgcggtgcaagcgggcatagattggtacaacaacgagcataaacacagtgaaatcggcaatgttacccccgcagccaaacgccgtgaattaatggcaaaaacgaatgaagaaaacttggtttacctcacccaagttgaagcacgggatctgttccgcccagcggtagagcgtacaccagagcgaggttgggtgcggttgtttaataacttttactttagtgcgaagttgttagaggtagatagagaaaaagtgcaggtggcatttgatattcacgacccaagccgtgtgattattcgcaggctagatggggtgtttgtctgttatgcagagcttgatggcaataagcgtgatgcgttcccgatgagttttgtggagaaaacgagaaaagagcgtcatcaacgccgaatgaagctaaaacaagagcaacttgatgaaattaatgcggaactcaaccccgtgcttaccattgaacacaaagaaagtgcggattggttacatcagttacgcataaataaacaaaatgaatgggaggaagacgcggaagaaattgcggttttcccaagtgaaatgaaacgtcaattattaaaaagaaaggcaggttaaacaatgaaagagcaattacaacactatatgcagacacaggggctaacgcaggggcaaattgctaaggcgattggtaaatccatcaccactgtgagccagtatttaaaaggcaattacaacgggaaaaccgatgaaattgatgatgccgttgcccgcttgttgcaacgtgaaaaagataaggtggtggaacgccgttttaacagcgaatttgtggaaacttacgcggcacagcgttgtttagatgctatctacattgcccacgcagaaagtgatattgcagtgatcacaggggcggcaggtttaggcaaaacccaagcactaaaacactacatggaacgcaaccctgaaaccatttttgtggaagttgaaccaagttacagcccgaaagtgttacttaaaaatctgtgtcagcagttgggactaaacgaaaacggactaaatcacgagctctttacccgtatcaccgaaaaacttggcgaaaaccgcttaattattgtggacgaagcggaactattaagcacgaaaagtttggaatatttacgccgtatccacgatttaaccaagtgcggtgtggtgttggcaggaatgccgagattaatcgttaatttaaaaggtaaatatggtgagttagcccagttatacagccgtgcgggcgtacattgcgatttacaaaacgccctagataaggaagacatcgccttacttgcccagcaaggcttaggtacggacgaatttaacgacctgctttacaaagtaagcaaaggcaacgcaagacgattgaacaagttaatgcgtggcgtgatccgcgtggcggaaatgcacggaaaaccgattagcgaggcactgattaaccgttatgcggaaatgttgattaattaaggaggaaatatgggctttaaaacaaaagagtttgataactggataggaaaaaatggtgacattttgatttctaaaaattcaaaagataaatggattgctgcagggggatggagcgaagaagaggacgactttactttgtacagcgtattaaagaatagaaaggcatggctgaatttttaccgtcaaacgagagtgactaaataaggattaaggagaaagaaaatggcaagagcagacattattgacacagcttatgcgttacgtcgtgagggtgtggagattgtgaaatcaaaagatgggcgttttccgagttttttaattttacgcccaagccaacgcttaatagcaaatgcaacgcagattgtggaacgcattaacgggcaacgccgtgagcggtttatcactcaagtgggaaattgtacggtgtactggttttgaggtgagcaatggcaaagtctctggatatttacgccgtctatgagggtgaggataacttaggtgacggcacagcggaacagttagcaaagcaatttaacttaagtaaaacaacgatttaccgttatgctaagttaggcgataaaggaagtaagaaaaaacggttaatcatcatcaaaattgataaagaggaaaaagaaaaatgaaaaaaattgccgtaatttgcaccgcacttttgttggcggggtgcattgaaaaagcgccacttaatgatatacagccaataaaaaggtatcaggtaagcgcatacggcgaacttaaagaggtatgtattgatggtgtggtgtatctactactcataaagggtggtattaccccaaaaatcaacgccaattatgacgtttatatctgtaaccaatcaactaacccataggagaaaacaatgaaaactgtaatcgaaggcaaaacctactggaaagatgcaaaaggcaaccttaccccagaagaattagtgaaagacatcgacaaagaacgcgatgcactggtgcaagaatgggtagaaaaagccaaagccttaaacgcggaaatgagccgttttaaaggcgggatttttggcgatattcaggcgtttgtggaactttccgccgaaaaatacggcacaaaactgggtggcaataaaggcaacgtaacgctatttagctatgacggtaaatacaaaatcgtgcgagcgattagcgatcatttgcaatttgatgaacgcattcaggcggctaaggcgttaattgatgagtgccttagcgaatggtcggaaggctctcgcccagagctaaaaaccttgattgagcgagcgtttgatgtggataaagaaggcaatatcaacacagggagaattttaggcttacgccgtgtggaaatcaccgacccacgttggctaaatgcaatgcaagccattagcgaaagtgtgcaaatcgtaagcagtaaagcctatgtgcgaatttatgagcgggtgggtgatagcgatcaatatcagccgattagtttggatatggcggggatgtaaaaatgtttgaagatgttagtgatttaaaagaagcctatgatttttataaagcagttaagaaagataaagatgctattaggtgtggttgtttaagtgacgcagaagattggatatggagagagccgcatgcgttatttgcagaagacgatgagcaggaggtatagcaatgttagagaaagttgcaaaatacagtcgaattttttcgggagcagtggcgattaccatattgctgattgcagtgcctgtgttttttatccacgaagccgtagcgataaagttgatggcgtcagcgtgtaatttttttgccatttttgtcttttttgaggttttaaaccttaaaagttgggtacaacaaaatatcgcaacattgataaaaagtgcagaaattgcatcaaaagccgcttatagcttaaagcagcataaagggctaaatcttgtggtcaatggcaacacagttacacctgatagtagtgaacgggaggtataaatggaaatgttactttatatcgctgttggcgcatttttattccctttttgttttggtttaggttgtatatgcgtctataaaatgatggagaaattggtcaagttaaatatggcttaaagcccttttcaacacgctttaaagcccatttaaggcgtgtttataaagtgttttaaatcaaaaaataggagcaatgacaatgaattatcacgctgaaatagacgttaaattgactttgggtattgaagctgaaaccaaagacgaggcgatatgttatatcgaccaactactggaagaaatccatgaaggctacgctattggtctgaagtatcgaattaattttgtaaatgaggaatgcgacgatgaagaataaatatcttgtcagagtgtacggaatggttgaaatcaccatggaagccgaaagtattgagcaggcaatggcacaatgtgatttgaataccttagatttaaataaattgccacatcaaatcactgaaattgatgatgtagttgaagtggaggaagtatgacaaagcaaaaacaaagcgaactccagctcaagctggatatgatgatcggacagcttcaacaggcggttagagcgattaatacgggcaactatattgcggcgggggtgtatatggaaatggtgcaaaaccaactgccaaaggcgagatggcaggtaagggggtaaagatgaaatcttttacattaattttaacagcaacttttgattttcgcgatgatgaatttaatgatatcggttttaaatggtctagtatagacggaaaggcattattagatgcgccaagagaactggattttacaatttataaattgatgaaagattgtacttacgcattgcctattttatcccatttttttaaggagtttagtcaagagaagcaacccgtcatggcaactgcaagcgtgcagtttgaaggggaaaatgaggattggcagctagctttttctgcactagaaaaaaacgaagtaaacgaatatatccaaggattgctttttgggttgctaacacagagaaatgaacttttgcggaaggtgaagttattggaaaaggaattgtattaaaacccatttaccgcccttttaaatctcccctagcccctctttaccaaagaggggaactgaaagggcggaataatgtgttttaaccccgttttaaaaggagtttaaaaatgaaatgtaaatgccctgcgtgcggggcggtgttgtcgttagatgtgttgttgcaacacgagcaagcgagccttgcggtgatgaatgccttatcgctcaatggcgagtttgggcggttggcggtgcagtatttagctctattccgccctgaaaaatccgcactcacaatggatcgcttagcgaaactactcagtgaattggttgatgaggtgcaacgcgggcagttttgccgtaatgggcaggtttattcagcccccattgaatgttggattgatggcttaaccattgtgttaaatagtcgccaccatatcaaacgcccctcgcctcacacggctatttgtatgaggtgatgaccaaatggcaaggcagaaatagccatcataatatgatgaacggacaaagtaatccgcctgccactgccccacaattcggcagcaaaacgggcaaagctctgcaaaatttagcggagtttgccaatggctgacgaaaaatggctaaaacgaaccgtagctcaagggttgggaaaattggtggtgttacgccttgccaaccaaccgcccgaagagatgatcaaggctacggcagaagtgtgggtgcaggtgattttaagccaacgcatttatggcggctggcaagagaaagaagataaatggcgaattgaacaggcgtttatgcggttatgtgcagaatgtgagcgtttccccgccccgaaaatgctgttagaccgcttacccaaacgtaaaacccttgaactaccaccacctcaaccaaaaccattaaccccagaacaacaagcgtgcgtcagtaaaatgttaaacgaatggcgaggagtattaaatgcaaaacgatagttaccgaaaaaatctcattgctaaagtgcatattggtaaaagtcagttaaaaatggacgaagaaacctaccgcacttttttaatgaacgccgtaaataaaaccagttgcaaagcaatgagtaacaccgagcttaatcaagtgttggatttaatggcacaacgtggggcaaaagtgcggtcgaatttttggggaaatcgcccaagtccagctaaagcgaaaaagccgtaccttgccaaaatcaccgcattacttgctaagcataatcttacaccgcaatatgctgacgcgattggcaaaaaagcctttggtattgaatttattgactggcttgctgtgtggcaattaaaaaaagtgattcaaatgttgtcggtgtatgataataagaagaagttgtaaaacattttgcataagtataaattaaaggttcgttttgagccttttttaatggagcaaatatgagaaaactgataaatctcttaatatttacaataatacttattccagtatcactgcaattattatctaatcctgcttggggaaagggtcgttatctgccaaaatgcaatgaagtagatgatcttttaagccaaattttaaatcagcaaactaaagaaacaaatattgacttaacgctcaaaaacattactgctgttagagaggtaaaaaagatagaacaagataaaaatatacgtctttgctacgcaattttacaaacggcaacctacaataaactagaagcattatattcggtttctcctgatggtaatgatttttgggtgcaaatagaagaagtaaaccctattattgatgccaagacattaagtaaaacgggtgatatgttaaataatcaaatgggagaagatagattacaggcttttgaaatggcgaaaaaatttggtgatatgaaagaggcttgtctatccttgagtgtcgccaaaaatttttcttaagtgcaaaaaatgaggttaaatatatacaaaccaataaactattagaagagttctgcaaaaagtaagtataggctatctaaaatcccgccaagtgcgggatttttttcaaaaaattctccagttaagtgatcgtttgaaaaatcccgtgtgataatggcgaaaaaatcaatacgggagattaaaaatgagtcatcttgaagatgttgcagactgcttaccccctgttgtactggaaatggtggatttggtgggctttgaggtaaccgaaaaaatcattcgtcattttggcggggtatgttttttatttagtgatggtgcgatgtatttcccgaaactaaaatcgctggttggattagaacatgccaccgcactacgccagtattttaaaagtgaagaagtctatattcctcgctgtgaagtggcattaagaaccttacgtaatattcgcttggtgaatgactttttaattaaaacccaagtggagggaaaaagcgggcgtgcagcaatgttggaactttgcaccaaatatgccctttctgatcgccaagcgtgggaaattgtgcgtaatgcccaacgtaactcaccgcttgcaacccaatcatccctattttaactgtggaagtgctttgtctattaggctaaccacacaaatctgataatcacctcaataatgtctttgattattgaggttttttatgccctttccaattacaaaaattgtggtgcattgtagtgccacgcagaacggtaaatccttacgcaatgaaaggctaaccgcagcccaacggattgatctttggcacgctaagcgaggttttttgcggaaaaatcaccaatttaacccgtacttacgccatatcggctatcactttgtgattgataccgacggcactgtagaaacaggacgtgcagaaggagaaatcggcgcacacgttaaagggcataacgcccatagtttaggcatttgtcttgtaggtggcattagcatcacaggcaaaaactacggacgctacactgtcaaacaatggcaagccttgtatcaactcttacaaaagttagaagccaaatacccagaagcacgcatttgcgggcatcgggatttatcgcctgatttaaacggtgatggcacgattaccccaaacgaatgggtaaaagactgcccgtgctttgatgtttgggagtggctggatagcgagcaagtgattaatcaatcacacttatttaaggagtaattatgccaacgactattttaggtattatcgccgtaacaatggtaatcggttgttttttcaaggtcggggaagctatcggagcttgtatcggcgatcagattaaatatcgctatgtactttggcgagataaacgaggggaaaaatgaaactcagtgaattaattaccaacgataacggcaggcttagcaccaccgcctttatccaatttttcggagcggttttaatggcgatcattttggcgtatagcgtctatttagaccgtgcaaatgtaagcgaactgtttaccacctttgctttattttgtggcggcggtgtggccaccaaaggctttgccaatgcccttaatcgccgtaaatcttcactagcacaaggagaagaacaatgatgtggcagatgtatgcccttgcggggctaggtgcagtgtttgtggcgatttatgctcggttacattggcaaagtaaaaaactcagtgaaaagcaaaaagaaatcgaaatggtgaaagccgaagccagagccatcgcggaggaaatggaaaatgcagaaaaacgtcagcaaattgaagcagctcatcgccgtcttaacgctcacggcgttgatgaccagttgcagtcaaaaggttacttccgtgaggattagcggttgcagtgcgtttgggctgatttaccccagtcgtcaagatacattagaaaccaaacggcaggtgctgaaccataatttagcctatgagcagatttgcggggtgaaacgtggatctacaaattagcggtgagtgggtgtttaacggggtggtatccattgccgttacctttgtcgggttttggttgcgatcggtcaaggaagagctgaaagaactcaaacaagaatgcaaagacatccgcaataactatcaaactaaagagcttgccaaggtgcatagcacacacacggacaatattttggcggaaattcgggacgaattaaaagcaatgaatcataaattagacagcaaggtggataaataatgtcagccagagaacaaaagcgtttgaaccaacgcaacaccaacgaaaaactcgatgaactgttggatttaagcaaagaagcgaatcgcaaaatcgaccgtattggggagcgggtcaatgatattgatcatcgtttgtcatcgctcgaaacccaagtgggcaaagtgaccaccaaagcctttgtggctggcggtttaggtggtgcaatggttgcggtgggcattgagttaatcaaagcaaaatttgggggctaaatggctcacgatgagaaagtgcgggcattagtacgccgttattatgtgtttgaccgctttacccttgagcaatctgcacaaaaagccgacgtgtcttttggtacagcgcgccgttggaaagcgcaagccctaaataaaggggacgattgggataaggcgcgcgatgtgcatattatggcaggcggtgaagtgaatatgatttcgcaaggtttattggcgggatttattttgcagtatcgcaccacaatggacgaattacagcaaaacactgaattgagtgccaaggataaggtgatgttacttgccgcccttgcggatagctttaccaaaatgacggcagcaagtaagcggattttgccagaagtatctgaattggcggtggcaatgcgtaccgttgagttatttggtgagtatatccatcaacatcattcttccctaatggagccttttattgatgcattgaatggatttgggcaaacactcaatgaggaatttaaaaaatgaacctattgagttttctttttgtgattgcggcttgcctttctgcccgtgatggtggggcgtggggctggtgggtatttttagcattattagtgagtgattaaaatgaaaagcaaagattttttgaaagaattaagtgcttatgctgatagcctacggcaaaagttagaagcctcttttgagggctggaatgatagccctgaagccgtggttgaacgccgtaaaaaagtgtttgatacgatttcgggttatgaatattttgtcaatcattactttccgcattacacccgctcaagctcaaaatccaaattgcatcattatctatttgaacgcttgcccgccattttacagcaagagaaaggttgcctagatgccattgctgcaccccgtggtgaagctaaatctaccttggtttcgcagctttatactctttattgcttggtgacccaacagaaaaaatattgcctcattgtcatggacagtatcgaccaagcctacccaatgttggaagccattaaagtggagttggaatttaatcaacggctacgcattgattttcccgaagtggcaggacaagggcgtgtgtggcaagcagcaacgattgttacccacgctaatcaaaaggtgcaagtggcaggttcgggcaaaaaattgcgtggtttacgccacggggcatttcgtcctgatttggtggtgctggatgatattgaaaatgacgaacaagtcagaagtccagaacagcgggataaattgcataactggttaaaaaagaccgtgttaccgcttggctctgcgggggataaatttgacattgtgtatatcgggacaatcctgcattacgacagtgtactcaatcgcaccttgcacaataaagcgtggcatacggcaaaatttaaagcactcacaaaaatgcccgacaatatggcgttatgggataagtgggaagatttttacctaaacgagggcgaagcggttgccgatgccttttatcagcaaaataaagccgaaatggacgcaggagcggaaatctcttgggcagctcgtccactcttggcgttaatgaaaatccgagcacgagatggacacgccacctttgatagcgaataccaaaacgacccggttagcggtgatgatgccatttttgccaacagtatccaatattggacatcactccctgataacctgatttattttggtgcgcttgacccttcaatgggtaaggcgggagctagtcgcgacccgtccgcaattttagtgggtggctatcatcgcgaaacaggcaagctctatgtgattgaggcgcagattaaaaagcgtctgcccgatttaattatcgaagatgtgattaggctcaatagccaataccaatgccaccgttggtttgtggaaacggtgcaatttcaggaatttttgcaaacagaacttgttaagcgttccgcccaacggggcaagcctgtgccagccacggcgattaaaccgaataccgataaaatgctacgtattgagagcttacaaccgcatatcgccaatggcttaattttgttgcatcacagtcaatccaccttaatttcacagctacgtcatttcccaaaagccgaccacgatgatggtcccgatgccttagaaatgctatggaaaaatgcggtgctcaactctgcctccattgagtggacaagcctgaatgaagcagagttagataacgattggcgtgatgaagatgatgatatttatagcatttggaaaggataaacaatggcaaagaaaaaacgcaataagcacaaacaagcacaaaataaaagtgcggttaaaattgggcaagattttcaaaccaacgaagctcgtattacggagaatgggcggattatttccgaccacccaagcaataaaatcacgcctgccaagttaaaaagtatttttgaggatgctgaggcgggcaatatccaaacccagcacgaactctttatggatattgaagagcgggacggcgatattgcggcaaatatggcaacccgcaaacgggcgattttaacgctggattggcgaatcgccgaacctcgcaatgccacgaccgccgagcagggctatcaacaagaggtggacgaatatttttatcaattttccgagctggaaaacctgctgatggatttaatggatgcagtgggccacggcttttcggcgttagaaattgattggcattttattaacggaaaatggcaaccaaaaacctttatacaccgtccgcaatcgtggtttaagattgataaagacgacaatttattactcaaaacccctgataattacgaaggtgagccactacgcccattgggctgggtggtgcatacgcataaaactcgctcaattcagttagctcgccttggtttgtatcgtacacttgcgtggcattatatgtttaagcattacgccgtccacgactttgccgagtttttggagctgtatggtatgcctattcgcattggaaaatacggtgcgggggcaaccaatgaggaaaaacgtacccttttgcgtgctttggctcaaattggacataacgcggcgggcattatgcctgaaagtatggaaattgagctacataatgcggcgaatggctcaagcgttaataacccatttttgcaaatgattgagtggtgtcgtaccgagattgctcgcctgattttggggcaaacgctcacatcaggagcggacggtaaaagctcaaccaatgcacttggcaaggtgcataacgaagtacgccgtgatttgctgattgccgatgccaaacaaattgcacagaccattaccaagcaaattattttgccttatttacagctcaatgttgatccgagcattgatgaaagccgctgccctcgctttgagtttgacaccgcagaatatgaggatttagaaaaattcgccaaagccttgcctgatttagtcaatatcggcgtggctgtgcctgaaagttgggtgcgggaaaaattgggtattcccgaaccgcaagagggcgaagcgattttaaaaaccgttcaaagcgactttaaagaagagttaaatgatgatgaaaaagaagaaaaaaccgagcaaaaacgcaccgcacttactttcagccctcacactgactgtggttgcggctgccgccaaaccgccttgtccaccgaaaaccaaagcacggacgaacagcagattttagataatgtgctagatgagggcttgcaacaggtggattttaacgcccaacttgatcctatggtacaaaaagccgtggcgttgatgttgagttgcgaaagttatgaggaagcgggcgagaaactggccgaggcttacccagatttagaaagtgacgaacatcacgcttatttaagtcgtgcgttatttttaagcgaattattagggggcagcaatgcccgccgttaattttgctttggggcttgagccaaaagaagccattgcgtttttgaaaggcaaaaaagctttacttgaccatttggacgagaaaggcttgctggaaagtgccagagccaaagccacacgcattgcgaacatcaccagccttgaaatgaccaaagatatttatcaatcgctgatcatcgctcaagagcaagggcaatctttcggcgagtggaaaaaaggcatttttgaacacttcaaaaagaaaggttggattgcgggctatgacaaaggctatttattggctgatccaaaaacaggtgagttttttggcacaccaagacggcttgaaaccatttaccgcaccaatatgcaggcggcttactcggcacagcgttatcagcaaatgcgagataatgtagatagtcgcccttattggcaatatagtgcggtcaatgatgaccgcactcgcccaagccacagtgcaatgaatgggttggtgtatgcctatgatgatccattctggcataccttttatccgcccaatggctttaactgccgttgcacggtgattgcgttagcggaaagagatattaaacggcgtaacctcatcgttagccaaagcgaggggcgattggtggaatatgaacgcaaaatcaatcagcgagaaaccgagaaaaccacggcgtttaaggtgagtgaagatcgttgggtgatcaccgaccgagggtttgattacaacgtggggcgaacgagctataaacccaacttagacctttaccctgaaaaactcgctcaccaatttgccaaacgggaaatgagcggggcgggctttcaatgggattttcaccaatttgaaaaggaatttaaggcagctaaacaagccttaaagttaggcgataaaccgaatagtacgcaactgaccgccatccgtaaccaactacggcgggaatataaatttaccgcaggcgtattaaatgcggcagataaagccaagctcggtagccaaactgcgaccgtgtggctgtctgatgatacgttaattaagcagtttagtagtcgagaggggcaaaatttcggggctgaggagtatgcggtattgcctgagttgatttatgaacctgatatgcttttacctacaagagaaaagcatttccagttttttaaacaaattaaaggtcatagatatactgtggttttgaaagtattggaaaatgaggtctttgtgcaatcattcagaaaaatgagtgagaaacagtgggataaggcattgaaaggtagccactaggcagggctcgaacccactgcacacaatccccggtactctttcaaccgttcgtccgcgatcttcgagattcatcgcttttctagtggctgtgttgaatatacccttttttatttttaatgacaataggagatgcaatggaaacattacttaacgacaaaaattggcaggcttacttacccttagctttgagcctacaggaaaaagatgagattaaagccgcattgctgaaaaacatagcgcaaacccctgacagttttactgcgctatgtgaatacttaagatgcttacgcattattgaagaatatccgttaaaaacggaataagtaattatctatgctggatttgctcttggtatagccgtttagaaatagccaagattaattgagttaaatgctcggcggtttgctcaacctcttttgtatcattaggcagagtataattggggtgggtaatgagatcacgagctaactcaatagcgagtttatctgtattagtagttctttctattttcatcgttatttccttatttaaaatgggcgatattacccattcttagggtagcagaggcatattatgattgaaataaaaatcaataatgaaaaagaggtctttgcgttattggaacgcttaagccaaggtgtgcgttataacgcccctttaatgcgtaccattgcagggacaatgcaatcagcggtcgatcaaaactttcaggcaggtggtcgtcctaaatggctgggggtaaaatctcgctccaatggttcgcccttgattgatagtggggcgttacgcaatagcattcgtgccagttgggataatgatgaagcccttgttggcacaaatttagcctatgcggcaattcatcaatttggtggcaaaaccaaaccgcataagattaaacctgtaatgaaaaaagccttgagctttgggggtattgtgcgaaaatctgttaatcacccaggaagcaatattcccgcccgtccatttttgaccctaactccacaagatgaggcagatattttagaggacgtgcaagactattttaaacagataattaaataatgctatttagcccctaaatcgcacgctgtgcgattttttcttttagggggtacgatttatcattcaaaaatttttaaaataaattaaaacgatttaaaacggttttaaaatgggttgtgttttaaatcagtcagcttctttctatttttcagctatctctcttttccctctcctttctgttgtgtggaagcctattcacagttttagcacatcgcaaatcgctatgctatgtcaagattaagcaataaaggatttttttgatgaaacttgcagcctgtagttttgagttgagccaagccaaaaatgggcgtatccagttgttgccttacggtgcatttcgagccacagacggacgaccttttgacgtggaggcttggtatgtaacagacacaaacggtaacgatgtggtggcattggcaaatagccaacgcaacccactcccaattgattacgaacatcagattttgcactcacaacaaaatggcaaagaagcaccaagtgcggggtggatggattacctctattttaccccgcaaggtatttttgccgatgtgcgttggacggacaaagccgccgactatatcaaaaacggggaatatcgctatatctctgcggtgtttagttatgacacgcaaggctatgtacgcaaaatctttcacgccgccttaaccaatacacctgctttagatgggatggatgaggtgatggtggctgccagccaacaatttttaaccaaccaagaggaaacaccaacaatggataaagccttacttgcggcattgtgtgcgttatttaacacgccgaatgccaccgaagctgaaatcagccaaaaaatcaccgcacttgcacagtccaaaggagatagccaagtggcgttatcagaggtttacatcaagctcgctgaaaaagagcaatctgttgtggcattgaccgcacaaattgccaaccctgaccctgctaaatttgtgccagtggagcaagtcgctgccttaacggccgagttcacgcaatttaagcaaggcattgagcaaaaagaaaaaaacgcattaattaccaccgcactttcgcaaggcaagctcgctcctgcattaaaagactgggcagaaagtttaaaccttgcagcattaacggattatttagccaaagccccagcgattgccgcattaagtggcgaaccacaagccaaaactgacccgaacgaaaatcaagtggcagccttaagtgcggaagataagcacgttgcaaaaatgctgggcttaacggacgcggaatatcgtaaaaatttagaaacaggagcttaaccctatgagcgttgaatttaaaaaatcagaaatcttaaaaaaattagatacccaatttcgggcggaatttagcaaaggaattgcccatattcaaccacaatacccgaaaattgcgatgactgtgccgtctaacaccgcaaccaatacctacggctttatgcgtgcgttcccgaaaatgacggaatgggcaggcaagcgtacgattaaaaatatgtcagcggtgggaatgacccttgataacaaaaaatacgaaagcacggttggcgtaccacgtgaagccattgaagatgaccaagtgggcttattccgcaatatgatggctcaagcagggcaatcggcagcggaattgcctgatgagttgatctttaaattgttgcttgcgggtgaaagtacgctctgttatgacgggcaaaacttcttcgacaccgatcacccatactatcaagatgtcgatggcacgaatgcgggaacagcacaaagtaacattaccacaggttctgatagcggtgcgaaatcttggtatgtgctagataccaacaacgtgatcaaaccgtttattttccaagagcgcaccaagccagagtttgagggcaaatttgatccgtctaagtcagataccgtgtttatggaagatgtgtatttatggggcgtgcgttatcgctgtaatgcgggctttggtttttggcaactcgctcacaaggcgaaacagcttaacttaactgcggataatgtgatggcggttattaccaaaatgaccaccttaaaagccgatggcggggcgtttatcaatgtgcgaccaaccacgcttttagtgccaccaagtttagaaaaagcggcgttagatatttgtaacgctgatgtgattggcggcacaaccaacaccttaaaaggtcgcttacaggtaatggtatccccttacattatcgaataatcatttttccccgcctgcgggcggggcgttaaggagaaggattatggcaagaaaaaccaaagcccagaaagaaaaaacggaagcggaaaaagaaaacttagaagctaacgtgaaagatgacgcattaaaaaacgatgctgaaaccgaccgcaacctagaagatagcacgacagccaaggcagaagatgagacggtaaaaaacgctgacgaaactgaccgcactttagaagagggtgcaacagccgaggcgggcgatgaagcattgaaaaacaccgctgaaactaactgcactttagaagatgacaaggtggttgaaggtgggcaagtgattaacccgattgcttatgctgtcaagttgcgtgccattcacccgcacgacagctacgggcgttgtggttaccgtttttacaaagacaaagaaacggaaatcccagcgaacgacttaacgggagagcaggttttaacccttgcggaagatccgtggttagaacttgtgccagtgtgtgaggaatagcgatggcttatgcaaccgttgccgattttgtcttgcgtgtgggtgagttacaagccattgagctgaccgaccgcgatggcgtgggggaaattaatgagcaggtgttagaacttggactagcggatagctcaagccagatggacggttatttgtcagctcgttatgccctgcccttgctctccgtcccacaaaacttagtgcggttgtgttgtgatttaacccgctaccgccttgccagtatgtcgggagtggatattactgatgagattattgagcgttacaagctcagcctaaaagagctggaacagctagctaaaggagctatctcattagggttgccagagcttaatgcagacagtgaggacagcgagttttcaggggcgatattttttagcaacaataaaaacagggtatttagccgtgataacaaagattgaacaagccttaactgaccgcttgcaacgaggattaggcaaactggttaatacggtgaaaagttatggcggtgaatttgatgatgagagctttagcacagctcggctacctatgtgtttaatcacttatggtggctctcgcattgaacgaaaagccactagtgcaaagcgttatcaatccaccgatacctttgtgattatgcttgccgtgcgttctttgcggagcaatcaagccgcccgtcaaggtggcgtggataaacgcgaggtgggggttaatcagctcattagtgcggttcgccgtttgttagatagccaaaccttagggggattggtcaaaccgcttaagcctacggcagtgcgtaccatttttaacaatgccaagtttaacgcgagttcaattactgcttatgcgttggaatatgaagtggtgtatgacgatgttagcccgttagaagatgggttatatcccgaacctaccaccgatgaaaccagccctgattatgtgtttagcgtttatcagggggagcaatccgatcctgcaccgacattggaacatattaattttaatctttacaacccagatactaacgccgatcacccttttgtggtggcgatggaggaaaaatgaaagtaaaagccgcagttggcattaaagtgccaatggaaaatcaaccttaccgctatattgagcaagagccagtggaggttgaagacagtatctattatcaacgtcgcattaatgacggggatttaatcgtggtcaatgaaccgcgtaaccgaagaaatcgggaggcaaataatgactgatactaatatcgaatttgagcatattccaacaagccttagaatgccgggtgtatatagcgaatataacgctcaaaatgctgtgagtaccttaccaactaatgagcaaaatgtattgattattgctccaatggtcgggggcgatacggcttattctgcccctgtgccgatttattccgatattgatgcgaaaaatgcttttggggcaggttcttgggggcatttaatggctcgtattgccattcaaaacaacccgatgatccgtttaacggcaattggcttaaaagataatagctcaggcgttgcggcaacaggaagcttgaccttaaacggcacagcaacaggtgcgggcgtaattaaagcgatgattggcggggtggaatatgccatttcagtggcaaaatcggaaaccgccagcgacttagccacccgattaagtgcggtgatcaacgcgggtgaatattgccctgttacggcatcggtgagtacggcaaccttaactttgacagcaaaatgtaaaggggaaattggcaatgagattgaacttagcgtacaaagtactgcacaaggcatttcagcggaagccagtgcctttgcgtcgggttcgcaaaatgccgatcttgcccctgcacttgccagtgtggcaggctcgcattatcacattatcatctcgccgtttgctgatgataaaaatgccaccgcacttcgcaatcatcttgagcttgttgcaagtccaacggagaaaaagcctgcgattggggtgctgggttggcgtagcacgatggcagccggcacaacctatgcgagcaaaattaatgccaaccgtatcacttgtgcgtggtacaaaggggcgcttgaagcaaatgctttacttgcagcgggttatggtgcagtcattgccagtgaggaagaccccgcacgtccgctcaacaccttagagttgaaaggcttaacccctgttgatgccacgcaaacgccattaaaaaccgagattaatcaagccttatttaatgggctaacaccgattacggtggtaaatcatcgggtgcaaattatgcgggcgattaccacttacaccaaaaatcctgccaatgtggacgaccccgcgtggcttgatttaactaccattcgcacgatggactatgtgcgtaaagcggttgaacagcgtgttgccttgcgttttccgcgttcaaaactgtctaaacgcacaccgccaaaagtgcggtcagaaattttagatgtgttgtatcgcttggaaaaccaggaaattatcgaaaatgtggacgcacataaaggcaaattattagtggtgcgtaatggacaagacccaaaccgcttggatacgcaaattccaacggatgtggtgaatggcttgcacgtggtggcaaatcgtattgatttaattttataggagtaagtaatggctgaaaaatatgcaggctctgcggtgttagaagtggacggcgtagagattgagattgccgatctaaacgtaaccaaacaaacagggcgtaaattggtgaagacaatgaactccgaagggcgtgctagaggctttgccaaagggattgccacttgggaaatcagtttaaccgcagccctcccaattgatggttctgaaattgattgggcggaaattagtgatgccaaaatcactatctatccccttaatcaagaagataaacgtacctcttatttgggctgtttcactacgcaggtgggggaaaaatacaccgtagataatgaagctgtgattgatattcagatgaatgcacttaaagaggtgagcgaataatggacggacgtttacttttaggcttgcccgttgatggtaagcgatattttgattttaaggtgcatttgctcacattgggcgatgagtgcaatgcccttgagatgattgcgaatcttggtattgctacaggtgaggctaagccattaagccaagcagaaaaaatgctgatggatttagcctatttatgccaacaagtggaatttgttggggtggataaacaatatattacccctgaatacttgctaaagcgcctggcaacagatgattatctcctgattgctgagactattttggcattgcgaaaaaagcatatcgccgctggggagagccaacaccaagaaaacagccacgccccaactgctatgacttaaaggcggcagagcaacattatcgaagtgcggtggtttttttagcgaaattaggctttacgccccagcaggtgcgagaaatgagccatttagaggtgtcggcttgggtggaaagtctgttgcaatctcaaggggcaaaatcacaagcgaatggcataagcaaaggcgatacggtgcattacaaccttgtacgccgcaggcaacaacaagaggcgtaagcctcttttttttatgggtttaaaacaaatttaataagggtttaaaaatggcaaatctaaaaatgtctttatggcttaaagctaaagattttgcaagtggcgttgtcgataaaatgcgtagcaatgtcaataaagcgaataaagatattgaaaatcaagcggtgcgaagcgggcaaaaacagcaagaaaccgtaaagcgtacggctcaaattaccgagcaatcttatcgccaaatacagcaagctgctcgagcaaggcaaagtttgggaatgcggagtgaaaatgctatccagcgtgaaattaatcaaaccattgccgcttatcaacgtttaaaaaccagtggtgtcgcctcaagccgagaaattgcccgtgcggcggtaatagctaagcaaaaaattgcccagcttaatgcggaaatgggcaaagtgtcgacagggcaacggttggggaatgttgttggaaaaaccatggctattggcggagcggtttatggcgtagccagtacattaaagcccgcaatggataataaaaagcaatgggatcagaatgttgctcaagttgcattaaccgccttcaatgatcaagatgcggattatatcaaaacaacaggtatcgcacgcgtaaataaagcagcatatgaaacaaccaaagccgttggtgcgggaaccacggatatggcgttatccgcattagatggaatgattaaaaatggtttatcttttgaccaagccgaagcaacattgcctacagcaatgaaaatgatggttgcgggacaaacagacggtaatcaagtgggtgcacttcttcaggtcttgaaaaattatggctttaagggagaggatttacaaaaagccttagaggttactttgcaatctggttttgatggtaagtttgaggtgtcagatatgatccaacacctacctaatttgctttctatttctaaaaatgcgggctttcacggtttagaagattacaaatatttactttcaatgacacaggtggcagctaatcaagcggggtcaaatgatattgctgctaataatgttgccaactatttgaataaattaaatagtgtcgataccgcacaacggttaaaaaaagtggatatttccaataaaaaaggtttgcaaggcattgatttagaaaaatcctatcagcgtggtttagccagtgggaaaaatgcttcacaggtaatggtaagtattgctgaaacgttgcttaaaaacgatcaggaatatgtgaagttacagcaaaaactgttgcaaaccaaagatgaacagaaaaaagagcttatcaaagcccaaatggatttaaaaaaaggggcggtgcttggtaagttgttgcctgatgtacaagcaaaagcagggtttaatgcggtaacaacccagcaagaaatggataagtatcaagccaatcttgaggacggcaaaattggcaaaaatatggataaatctgtcaaggtgcttgctggaacggatctagctaaagaagagctagccaattccttaaataaatttagtcaaggcgaagtcaccggctggttaaatagtattgaacgtaaaattaatgacgaagtgatttctgcacatcaaaacggcaacgggcaaatggtgggtaatttaggcttagcaatggatgtgggaaaatcagcagtgggctatggttttggtggctgggcgttaggaaaaggattatctggcggtttggggcgagcaggcgttggtgcggcgacgggagcaggtttaggtgttgtacccgttttaaaagcggtaggtaaagtgggcgttgttggcacaatcgcaagcttaactacatcacctgaattagatagtaaatctcaacaacttcttgatttacaacataaagtacgttcaggaacagccacagaggaagaaaaacaagcgttaatgcaacaaattaaccaatctagagaagaagcaaaattacaagacgcactttataacacaggtaattcacttggtgcgtattttacccgtaaaagtgtagaaaagtcttatatggcttatctcaatagccgtttggaaaaaggtgatatttcggaagaggttcgggctcaaattgaagaacgaaatgcctattatcagaaagagcaggcaaattcatttcgttttcgtaaaggatcaccttatgttgcttcttctcattttagtgagcaagctgatcaaagtgcgactcgcattgcaggccttagctcgcctatcggtttgacaatgccaaccgcggagggaggaacacttgcaaaacttgagcccgccttgtcgaacttagccaattaccgagctgactttgagcaatttgggcaaaccttgagtgatgccttaaaacaagccattgagagccaaaattttgtgatccaaaatcaaattaaggtggatttagatggacgaattgtggctgaacaaacttcagaatatcactatcaagatttaaaacgttgggggtaaaaatgaaaggttggacaatgcctattcaacgcgccagttatcgtggtgtgcgttttgaggtgatttcggtagatgatgaattaaaccgtgccaccattgatcacgcctacccttttgttaatggggcggatattgaggatttgggtttaaaccctcttacggtacgaatgcaagcagtgttttatggcgagggctattacacggatttcaagcagtttttaagtgcgttacaaaaacaaggggcagatgtgctagtccaccctattcggggtcggttgccgaatatgctttgcacttcggcaaattttcgccacgatgcggaaatgattgattatgtggcgttagatttaacttttgtagaaagtacacctgccaagccgatttttgtttttgagttttcttttttggctaaaattgatgaacttttaacacaattggaagattttattgatgaggtattagcgttttttgctcaaatcatggaggtggttgcctttgcgatgaatgtaaaatcacgtttattaggggcttttggtgcattacaaggttgttttgaacagctttgtggtttatttgatatgggcaaaacttttttttcattgccttctacatttggtgcaatggattttaaagcaaaatcttctcataccgctaaagcaattacacatattatagagcaagggctaacccaagttgctcagcgttctgatctcacaactaaagcaaaatttgatgaaacaataagaacggtaaagcaaattcaagccattcctcaaaatttactttcaggtaaaaatatgaatttatcgcaaaaacaggggataaaatcattaacaatgtcattgtcaactgaaagtattgaaccagtgcatttgttgatgcaattaacttgtacagcgacgttaattcatttggcaacggggtttattgaagacgaaacattattgccgcaagagattgactatattacaacccttataaggactcatattgtgtcaaccttgcaattattgcgtcatcaagcccaaaaagagcaagcaaattctgcactaaattcaaccgcacctaatactggggtttataccgctactcagcaaattgcggagagattacgaactttatcccatcattttacccagcttgcaatttcggcgattaatcgtaaaccaccattaacggttagggttgtaccatttaatggcacgattcaacagatcgcccatgcgttttatggagattatcgccgttccgatgaactgctacgcttaaacccacaagttaggtttccgaattttattgctcagggggagttattaaatagttatgtcaattaattatccttatgaaaatgatgtggtggttgaaattgcgggacagcagcataaccactggaaaagctatgacattgacagtgattttttaatccctgcggatgcctttcgttttgaaatcggcgtggcttcagagcatacccacttacccgatttttcggggcaagaagtaaaagtgcggatcaatggcgaggtggtgctgacgggcattgtggacaccacccagcacgggattagcaaaacgaaccgcacttttagcctaaatgggcgagataaagccagcattttagtggattgctctgccccgataaccaatgtgaaagggctaacggtgcttgaggcggtgcaaaaaattgtgaatccgttgggtatcacaaaggttgagcttaacgccgaaaataatcccactttagataaagtcgatattgaagtgggcgaaaccgcgtggcaggctgctatccgttgtgctaattctgcggggctacatttatggtttgatgcccaaggtacgctaattgtgggcggtgcggattactccacaccacctgtggcaacgctatgctgcctaaaagatggtaaacgcaataattttgagcaagcagagttgacctatgatgtatcacagcaatttagtgagatcacctttttagctcaacgccacgggcgagctggggacgataataaaaacgatttaaaatgggtgtacaaaaacgaggcgatgaccacttataagccgaaaacggtggttgtgcctgatgtggaaaatttggcagcgttgcaaaaatgggcgaaaaaatatctctcagacagcattttagaaggctttacgctaactatcattgtaccagaccataaaacccaaacggggcaattatggcaaccgggtcagcgtgttcacgtgatttgtgaagaatatgatattgatgccatctttttcttgataggacgacgttttaccctttcccgttcaggcggtacacaaaccgaattacgcttaaaacaagatggagtttggacacccgatgcttatgttggcaaagcggaaaaagcccgcaaacggaaaggtaaaaaaggtaaaaatgggccgttaatggcaacaacaggtgatggtaaatgggagatagttaggggtaaataatgcgtcgatttagtcaagcaatacaacaaaccgcacaaacgacattaaatggcgtgcgtcaggcttttcgtggcgtgctaaatttagtaaacagtgcggataatattcaaaaaacgcaagtatcagggctagctgacgagaccttgcaagatgtggagctaatgcagcattttgggtttacctccgttcccccagctggtacgcaagcggtgattattcccatcggtgggcaaacctcgcatgggattgtggttgcaaccgaaaatggggcgtttcgggtcaaaaacttgcaaggcggtgaggtggctatctacgaccaaagtggctcaaccatcgtgcttaagcaggggcggttaattgaggtggattgtgatgattttgtacttaattgcaaaacctatcaagttaatgcgacaacgggggcaaattttgatacgccaaagttagagaccacgcaagttttaaccgctcaagggaaaattaatggcaacggtggtatggcggtgcaaggtggcagcggggcaacctttaacggtgatgtgacgcaaatcggtggtaacattacgactgatggcgatgttaacgcaagcggcaagtctttggttaatcatactcacagaggggacagtggtggcaataccggctcaccacaataaatctatttacaacaataaaaagcggtgtggaactccatcaccgctttttttgtatctgttttacgtatatttgtcagtatggacagagagttaagcccgcttactggggactatacaagtaagacaatcagtacgctcgctaatgcggcgtatatcagattaaccacacctttaggctcttggtgggcagatgggcgtgtaggctctctgctccacttaattcagcgtgaaaaagacttaacccgtgttggacttatcgcccaacaatacgccgaagaagccttacagcccttgcttgatgatgggcgagcaagtcaaatccaagtaacgcaccagcaaccacataatggctggttaattttacatattgaaatcattgataatcggggtgaaacatatcgctttaaacaccctgtaaaagtcatttaacgggagtttaaaaatgtttgttgtacccaccttagatgagataagagcaagcattttacgcgatatgcaagcccttgatcctcaagccgatgtgagcgtagacagtgataattacgcccgtgcctcaagtttagcagcggtggctgaaggtatttatgcacatcaaaaatggctgattaaacagttttttccagataccgccgatacggaatttttagagaaacacacgggattgcgaggcattcgccgccgtaatgccacctatgccagcggacgaggggcaaccattacggggcaagaaaatgccgagatccctgcaggattgcaaataaaaacggaagataaccgcttttttgagaccctagaaagtgcggtcatttctagcacgggttttgtggttgtgcctgttcgctcccttgctacaggagcgggacaaaatattaaaacccaaaccaaaggcagttttatggctgccccagttggtgtgcaaagtgaagtgatactcaatgaagtcattggtgcgacggacgcagaaagtgatgcttcactgcttgagcgtttgcttgagttgatccgccgtcctcctgcaggaggcaataaatatgattatcgcaattgggcgttatccgttgatggcgtaacggcggcttatgtgtatcccttgcggagaggattaggcacggtggatattgccattacggcagacaatgatgtacccaatgaagaaaccattcgccgaacacaagcctatattgatgatgtccgtcctgttacagcgaaagaaagcaaagtggtaaagcctgatgtaacgaaaatccattttgatattcaggtcaaaatcagcggcattacgcttcaagagataacgtcagcaatacaagccgcattggctgattattttaatacgctaatccccggtgatagcttgattgtgtcgcaatgcgaggcagtggtgaataatttagtgggtgttgtggatcgcaaatttattaccccaactgcgaatcgtaccgctgacgttacccacaaaattgagtggtttagattggggaacgtgaatgtgtcggagatgcactaatggctaatgattacaaacacgcccttgctcagctctatccgcctgtttcctacaatattaacggtaaacaatttttagcccaatgtgaggttgatggaaaggtttttcaacgtttagaacagcgtgcaacggaagtgttaaatgtgattaaccctgaaacttcggggcaaatgctcgctgattgggaacggatttgtggaataaaaaccgatacccaaaagacctacactgagcgagtgaaacgggtcattttgcagcttaatgccattggtgggttgtctatcccctattttatgcaactggctcaaagcattggctatcaaattgagattaaagaattttcaccattgcaacaggatttgcctgttcccggtgacattgtgcaatttagagacgaaccgcaagaaagcctgatttttatgtggcgagtttctgttttaaatggtgatgacaatattgtgtattttcgagcggggcagtctttagcgggtgagcgactagttgagtttggcgatcccattattgaagccttttttaaagagttaaaacccgctcatacttactgttatttttcatacaaaggttaaaaaatgaaagatttactccctaaaattgatagccaagatggcgaatttcaaaatggcgacccagccagtggcacacaaggcacgcgggtaactgccgaatggttgaatagcgtgcaggctcatttgcgagatgtaggcgaagaggtgaaatatttgttattacaagcagggcttacacctatcccaagcaaaaccacacaaatttatgaagcgattatggcggttattaatgccaaccgcagaaatggcaacacaacccaaaaaggggaaatccaacttaccgacagcatcaatatggcatcaagtgtgtttggggcaagtgcgttggcagtaaaaaatgcctatgacaaagcggttgaggcggataatcacgccgaaagggcttgccatttggctgaaagcaagcaatcccctgccacaacattagccggctatgggattggtgattttaaggtggggacatccaccggtgatgccaatgattgcaagattgacggcaattattattttgccagcgggcaaaatttaccgagtgcgggggcgtggcatattgcggtgatgagtggcggacaaactaacgctatccgacaaattgcccgcaaagccaatgagagcaaggttcaaacccgttattttaacggcacgtcttggagcgcgtggaaagatgtaggcggtgatggcttgcccgttggctcagtgttggcatttcctgtagccgtgcaaaatccacaaggttttttgaaatgtgatggctcaacctttgggagaacaacctatcccgatttataccgcgcgttaggcaatagcaacaaactgcctgatttacgccgctctaatgtgggaatgacggcgtattttgcgacagataagattcctgatggctggattgcgtttgatgaaatcaagcaagaagtaacccaagaaaaataccctgagttgtataaatacctgattgaaaaatataccagtatagacaacgtccctaaagcggaagaccgttttttgcgtaatgctcatggtgagttgacagtaggagatgtacaacttggttcgttaatcggtacagattcgatagacggaaacggggcattttcgccttatgtgaaagctattaaaaacacttaccaagaaaccgttgaccaagtaggcttcgatccgttgctgaaagaagaaattggaaacggaagaaccgctgttaataacgaacattcccctgacggcggacaacctgaaaccaaaaaacaatacaacgccgggctttcgtggtcggtaggaacggacagaaatactgacctgaatgaccctattaaaaataaaagtaatggcaacggtcattttgtcggtgtaacccgtccaaaatctcttgtattaaaactttgtattaaggcgaaaaacagttttgatgaggttctgttttggattaaagcattcggtgcggtggaaaatcaaggtgttttggatgcctctgctatcgttcaagatatgcaggattttaaacggcaagccgaggaaaaaatacaattcattacagtgcagaaagaagagattatgcacgccatacaagaggagatggaaaaatcagattattcccttgttaaggtttgggaggggaagaatatatattctgatgggtcaataaaattaagtgaaccttgttttggctctactgtttttctgtttgcttacgctgatagagaccatccaagggaattagttgtttttagttttgatgttcctgataaacatattgatttaaaaagaaaaaattcagatcaatacacattctatggtatggctcattacacaagaagcggtggtcatgatccatctcttacacatactaagattaacattaaccgaaaaacaggagatcaaatcaaatttgaggatttttatgcgggatataatatttacttaagagaaatctatatcaaaaaaccaaacaacaggaaagcaacatgaacatttactttcaaaaacaacaattaagcaattatcaaatttttccaatccctcaggatgtagagaattggattgaaaaagacgttgacgaaaaggaactggaaacgcatgtattggtggaatttaacggcgagtatcaatgggtcgagaaatccgctgacccgatgacgaaatggaacgggaaaacatgggtcgttgatgaagagaaaatgaccgcacatttaacccaagtgcgggcggaaatgcgagagaaaatcaatgccttgcgagatgaaaaaatcaatggcggggtgtttgtggaagcggtgggcaagtggattgatacggacgctacggcggagcggaatatcttatccgtcaaagccagttatgatttattcggtgatatggagattgcgtggacttgtgcggataactcggttttgatgataaataaggaaaaattaatgctgatttggcaggcgttaatgaatgctaaaacaggtaatcatgctaatgccttgaagcataaaaccgctatggagcaatcggacaatccggcggaatatgattattccagcgggtggacaaccagttatggggagtatttgaaggagttgagcaatgagtaaggtgtatttagctctgtacaagggccgcggcggtagtctctatgaccgatttatagattggcttattcgtcacatcacgaaggggcaatatagccattgtgaaattgcggtagaaaaamcggcgtttttaagtggcgattattatccgtatatcacctacgattgctacagttcaagtcctcgtgatggtggtgtgcgacacaaagtgattgaccttaaagacggcaaatgggacttgattgaactgccaaacatcacggcagagcaggtcaaacgctactatacccaaacccaaggcagaggttacgattggtgggggatgttggggattgcctttggtatccagcaaaaacgctcacgctacttttgctctgagtggtgttttaacctaatcaaaaatggtgacgagggctggcggtttagtccaaatcatttagcggcgatttttagacggggagcaaaatcagattattccgcacgaagttgatattatttgggaggggcaaaatgaagtaaccgtttagagcaaaagaagaagcggcgatgtggtaggctctgacctctaccacatcagcctaagcagatagtgcctgcatagacccgagaccgctttgtctgaccagacgggcggattgtaacaaaaccgcgtaaagtgagaaagtctatgcaaaaagatttgcaagaaatacggtgcaagtgctgtaaaaagcttcttgcacgcacaaaagataatcaatatttagaaattaaatgtgtgcggtgtaaaaccttaaacacatttaaacctactcgttaaacaactcagagtgtccgaatgccttgagcgtcagaacgccataatttaaggataaattatggcaaacaagaaaatcattgtttgggcgttatttgatagcggcaatggctgctatacccaagccgcccaaccattccctaacattgaaatctatcctatcggcattgatattgagcgtaaaaatcggcattttttaccgctgaatttagcggattttggtcggttgtttggtgataatacgctgtttaatcagctagatagcctccctaaacccgatgtcattttagccagtccgccttgtgagagtttttccgttgccaactctattaagggcgggaatgtctgttggcaatggcagggaaatacacgctttgctattcgccgtcgcaaagattttgacgcggcagcggttaaaaagcgacgttatcgttatgagacctcttttttgaatcgaattaatggtgagctttgcatttataacaccattgagattattaaacggtatcagccgaaaatttatgtgattgaaaacccttatgcgagccgcctttggcactatcttgatgagattttagcctttcctcttccttatgcgaaccctacctattatgggaattatggctggccctgcaaaaaggcgactaagtttaaaagcaatattccgctaaatttgcgttatcagcattatatttcgggcaaaacgatgtttgactgtttacacagttataacgcccgttcagccattccgttgccacttatccacgatatttatcgtcgtattattgaggtgttaggaggtaacgatgcgtcattttagtcaagcaccgttgccatttgtcgggcaaaaacggctgtttttaaacgcctttaaacaggttttaaatgacaatattcaaaatgatggcgaaggctggacgattgtcgatgcctttggcgggagtgggctattaagccacgtagcaaagcgaataaaacccaaagcacgggtgatttacaatgattttgatggatacgcagacagactaaaacacataagcgatacaaatcgtttacgagctgaactgattcaaattgttggcgatattgtaccaaaaaacaagcgattagacgacaataaaaagcaagaaatcattaataaaatcaatgattttaatgggtttaaagacctcaacaccattgcaagttggttgcttttcagtgggcaacaagtcagctcatttgaggagctatttagcaagacattttggaatggaataaagctggctgattatcctagtgcagaggattatcttgatgggcttgagatagtcagcgagccatttcaacagtttctgcctaagtttgccgacaaccctaaagccttgtttgtgttagacccaccttatctttgcaccaagcaaaacagctataaaatggcaaattattttgatttagtagattttttgcaacttattggcctaacacgaccgccttatgtgttttttagctccactaagtcagagtttgtgcggtttattgcgtatatggtgcaggcgaaaaaggataactggcaagcctttgatggagctgagcggatagtccttcaaacatcgttaaactatcaggttagctatgaggataatttggtgtttaaattctaaaaattaaggggcgaacgcccctatttttcaatgcccgccttatagcctgcctcataagccgcacgcatgaggcgtttgatattccacacgcccatatcataaaaatctaaatggtcactcattcgggtctctaatgtttcaatatcccccacctcttttgcaatggtttctaatatttttgcgatggttttttcagttgtttttttcattgcttattctcctcttaaaatgtttacgattttgtcagcgatttgctggacggcaatgtcaaagttagtctcgattgaaacgcgttggcgacaatgttcagagtgttcaaccagcgtgccttgtggcatataaagtaaataaattgttggctcattttgataactatcttgacagacttgaaagcggcgtttcccttgcacaaattccccatttttaaagccgtgatggttttcaagtctggtggttaagtgttgaataaatgctcgtgtattaaatttcatttttatgcccctgttgttttgtgttggggacatcattgctcgttggggacgaggagtaaaggggaaataagcagtagttaagctgactgactaacaatgtagctggggaggtatggaggtctaaatgataaaaaatttgaaataattttgcataatctgagactcaatagctatgcaaaataaatttaaattttatgcgaaatgttttgcgattttataatttctccaattgttaaacgtggagacagtgaattgaaaggatcttgaaaaacaatctgcatgtcttttttcaatgcttgagctttttctttcgataaagtggcgatattttttccgttaaattgtaatatcccctgataatcaagaatttgcataatagcacgtcccaacgttgatttacctgaaccggactcaccaacaataccgagggtttcaccgacttttaactcaaaagaaatatctttaacagcatggaaaacatttttcggtttaccgaacaatgtgcgttttagcacataatcaatatgaatattttgtccattgatgaggacaggtgcattttcagccaacggatgttttaaatccgtagggataggcgtcagtaattcttgtgtatagggatgatgaggttggttaaatacttgttctgtattacctcgctccacaatttcaccgttttgcatcacacaaacgtaatcactgtaacgacgaactaaacgcagatcgtgtgagatcaaaatgatcgccattcctatatctcgttgtaattcaagcattaaatcaagaatttccgcttgcgttgtgacatcaagtgcggtcgtcggctcgtccgctattaataaatccggtttattaataattgccatcgcaatcatgatacgttgtaattgaccgcctgaaaattcgtgtggataacatgccattttcttttccgcttcgggaattttcacttttttcagcatatccaatgcgtgcttataagcctccgctttactcattttcggatggtgaatagcagtcgcttccgcaacttgttcaccaatcggcaaataagggttgagtgaagtcatgggttcttgaaaaatcatcgccatacgatcaccacgaattaatcgcaactctttttctgataaagataatacttctttgttttcaaataagatttttgagtcttcactgtaactgatgattttttgcggcaacaattgcataattgccatagaagttacagatttaccggatcctgattcgcctacaatagcgagagtttgtcctttttctacctcaaaagaaatattacgaacggcgtgtacgacttcttcatctgtttttagataaacatttaaattttttacatcaagtaatttcattctattcattcctatttatcttttggatcgagggcgtcacgcaagccgtcaccaataaagttaaagcaaaataatgtcagacaaaggaaaaaagcaggaaatgcaatcaaccaaggcgatgtttccatttgtgcagctccatcgctcagtaaggctccccaactgctcatcggttcttgtgtgcctaaacctaagaaactgagaaaagattcaaataaaatgagcgaaggtacttccaacgaggcataaacaacgacaattcccaaaacattcggaataatatgtttccaaataatttgacgacgggaaacaccacaaacaatagcagcctcaacaaattctttgttttttaaactgagtgtttgcccacgtacaattcgagcaaggtttaaccaagcaatcataccgatagcaacaaaaattaagaaaatattctggccgaaaaatgttaccaacaatataacgaaaaacataaaaggaaaagaactgagaatttctaatgtccgcatcatgacaacatctacttttcctcccacataacctgagatagcaccgtaaatagttccgatcatcacagcgataaaagcaccagcaatgccaaccatcagcgaaattcgcccacctatagcaatacgcaccaataaatcacgtccggaagcatctgtcccgagataatgcccggaaacaaaatcaggagcgatactcatcatattccaatcagtgtcatcatagctaaaaggaattaacattggtatgaaagtaataaatagcaacatgcaacaaatgacaatcaagctggcaactgctgctttattacgaaagaaacgacggcgtgcattttgccataaactgcgtccttcaatgacgctctcacaagcgttttgcatgatattttcttccgattttgagcggttttgacgattagacaacatgagatctccttatgaatagcgaattttcggatcgataaccgcatatagaatatcaactaatgcattaaaaaagatggtaagcgtccccactaatatggtgaggctaagtactagagaataatctcggtttaaagctccattgacaaacagctgccccaatcccggcaacccgaatacactttcaatgaccattgaaccggtaataattcccacaaatgccggtgctaggtaactgataacaggaagaagagccggacgcaaagcatgtttgaaaataatttttttcaatggcaatccttttgctttcgctgtacgaataaaattggaatgcaatacttcaatcatggaacctcgtgtaatccgcgcgataccggcaacgtaaccgatagtaagagaaagaacgggtaaaaccatataataaagttgaccgtcgttccaaccgccggcaggtaaccactttaaccaaatggcaaaaaataacactaaaagcggtgcaaaaacaaagctgggcatgatcacccccgtcatcgcaaaccccatcacaatataatcccagcgactgttttgtttgagagcggcaaatgtgcctgcaactaagccgataatgactgagaaaataaatgcgacaatacccaatttcagtgacacgggaaacgcagaagcgattaaattatttacgctttgatctttgtatttgaaagaaggtccgaaatcaccttgcgagagatttttcaagtaaagcaaatattgtttaaagagcggttcatttaagtgatatttcgcttcgatattcgccatgacttctggaggataagtccgttcggaagtaaaaggactacccggagccaatcgcatcagaaagaatgaaaatgtaattaaaataaacaatgttggaagtgcttccattattcgttttacaataaatttcaacatcaagaactccaaacagattaaatgagaaaaagtaaatgttatttaaaaataaatcgtcaaattcccctaacctaatgttatcaattagggaaatttgacgggataaataagtttaatgtttaataatataaagatttctcaataaaataatatcttgaggatctttaccttcatagcccttaacataaggtttcaccaaacgcgggttaacatagttatatatcggtatgataggagcatccgctgccaaaatcgcttcggctttagcataagctttcatacgatctgtcgcctcggagaattgataagactcattcaccgcttggtcgtaggccgagcttttgtaaaacgctaaattgttacttgagttggagagaaaataattgataaacgttgtagcctgattgtagtcagccgaccaaccggcacgtgcaatatcaaattgtttgttgtgacgactttcaatatacgttttccattcttgattttccagtttaacatcaactaaaccacccgtattatttttccaaattgatgccgcggcaatagcaacttttttatggttttcattggtgttatataaaatggtaaatttcaatggattcgatttactgaaaccggcttctttcaataattgaacggcttgctgattacgctctttcattgataatttagtatattcaggttgctgaattgcaccaccttccgcaatatagttcggcgtaaacacgtatgtaggtatttgcccttgccctaataccttatctgtaatgatattacgatccaacgctaaattcagagctttacgtacccgtaaatcattaaatggtgctttcgtattattgatctcatagaaataagtacccaatgtacgtgaagtaaacacttgatccggcatttcagcttttaattttgggaattgctccggtggtaatgcatgatccgttatttccacctctcccgcacgataacgttgtacatccgtacttggattttgaatcgctaagaatgtcgctttatcaatcacggtttctttatcattccaataaagcggattgcggacaaattcaattttttcgttgataacgtgtttcgtcaatttataagcaccgttacctacgtaattttctactttgacccaagcatcaccgaatttctctacaacatgtttaggcaaaggtaagacagagtgatgtgtggtcataccaggtaaataaggcactgaattgcttaacgttaccacaaaagtataatcgtcaacggcttttacaccgagagaatctacttttttcttcccttcaataacatcttgtgcattttcaatttgcatgtacgtcaaataagaagaataaggagaagccgttttcggatcaacaagacgttgccatgcgaagacaaaatcatgggctgtaacaggcgtgccgtcagaccattttgcatcatgacgtaatttaaatgtccattgcttaaagtccggcgtactttcccacgaagtggcaacaccaggctgaggattaccgtcagaatccaccgtaataagtccttctaaaacctgcaaaacaacctctgcttcaggtactccttctgatttatgagggtcgaaactttgaggttcagctccattattgatgacaatttcttgctttttagccaacacggtaccagccggaacattggctgcaaaagcagatagcgaaaaacctaacgccaccgttgtggcaataagagtgcgggttaatattgtgtgcattgttattctccattgtgattgttgtttgctctgctattaatacatgaaaagattgcttttgtaaataattcatactagttagatagtaagctaattagagtgaattattctagagggcaatgttacatgaattaaattcttaccataataaagtgcggtcatttctctaagtaaagatcgctgagtaaatagccaccttgcggtcttttcccttcataaccttttaatttcggatttttaataaataatccggcgtaatgataaattgcgataaagggatgatgtttgcctaattcttcttcagcttgtgcataaatttccgctcgtttgttttcatcactttcgttgtaagatgcttcaattaattgatcaaacttttcacttttaaagccgattttattttgcgaactattggaaagaaaatatgtcaaaaacgtgcttgcttcgttgtaatccgcagaccatgctgcaaatgccaagtggtaatttttctgattttttgtatctaaaaatgttttccactccatatttttcagcgaaatatcaaccagaccgtctaaatttttcttccacatagaagtaaccgcaatagcaatattttttagtccttcgttagtgttatacagtaattcgcttttcaacggatttgctttactgtaaccggcttcacgtaatagctttttagcttcttcgtttcgttgtgcttgcgtccaattagcatattccggttgggtgattttttctcctgcatgaatatagaacggtgtgaaacggaaagtaggtgtttgtccaaagcctaatactttttctgtaataatgttgcgatcgacggctaaatctaatgctttacgtactttaatattatcaaaaggcggttttgccatattcatttcatacataaaagtacctaatttacgagagctatagatttgcgagtcgtattgagcacgaaatttaggatcatgataaagtgattgaggaatataagccatatccaattcgccggaacgataacgagctccccctgcactttccgttaaaatataaaaagtagctttattaataacagaatgggcgttatcccaataggctggattacgttccaaagtgattttttcatttaacacccgttgtgaaattttataagcaccgtttactacaaaattttccggttttgtccaatcatcaccgtatttttcaacaacagcacggtttaccggataaagagaagtgtgttgagtaagaagaacggcataaggtacgggtgcatcaagggtgagttgtagtgtattatcatctaatgcggtaactcccaaaaattccggtgatttctttccagcaataatatcatctacatttttcattttcatgaagccaaggtaacttgcataaggtgatgcggttttcggatcaacaagacgacgccaagcatagacaaaatcatgtgcggtaagagaatcaccattagaccacttaatatttgggcgtagataaaaagtaacggttttaccgtcagacgaggtatcccagcgataagcgacaccgggaataatattaccgagttcatcggttttcaccaatccttcaaataattgttcagctattaaaccttcccccgatccttctattttttgtggatcaagggtagcaacttcagcagtaatttgaatactgatttcctgtttatccgccaattttgtaccttgaggaacttgtgccgaaaatgcgactgaagaaccgacaagtagaaataagcctaaaagtgcggttctatagtttttatattttaactttgtccatatattgtgttgcataaattttatccttttaagtaagattaaaataataagattttcattagtaaaatatttatgcgatgaagtaaagtatttttacaaattttttgtaatttttaattagcaacctaattactatttttgcattttcaaaaatgtaggagtagaattccgacatcttcaataattcatcataggcggtatttatgcaattgagacgtaaatacatcgcctcgtattgataggagcagtatatgcaatttgcgattatcggattaggtaaattcggaaaatcagttgcacgagagctgtataagctgggtaatcaagttgtgggcatggatattaatgaaaaaaaagtggagcaatgtagccattttcttagtgcaagtttaatccttgatgccacggataaaacagccttgcgagaacttaacattcaagagtttgatgcagtgttggttagtatcggtgaaagtctagaaagcaatttactctgcacacttaatttaattgatctcaaagcaaatcaaatttgggcaaaagctaaaaatgcggcacatcacgctatactttccagtttagggattcaacatatagtaagacccgaaaatgatatgggtattttagtcggtcaatctatgaattgccctagtgtaacccactgtattccgctaggctcggatctctttttaattcatttccttgttcaatttcaaactactattaccctcggtatgctgaaaaaacgctataaagatattgttattaccgctattcaacgaggagaacaacttattagcaatccggatgatgaaactgaaatacatcgtcaagaccatttgctgatcattggctatttaaataatctccgcactttaaccggcgaattaaataaaatccaaaatgaaatttgaacatatcaacacaaagccaccctatgtattagcgggcggttttctctttatcattttaatcggcacattattattggaattaccctttgctcaccataaaagtatttcatggctacatgccttatttacttcaacatcagcggtaacggtaacggggctaagtgtcgaagatacagcaaatttcaccctattcggacaagttgttttaatgtgcttaattcaaatcggcggattgggatttatgacgtttgctatttacatagcaagacgaatgggtgccagaattggcttattcggcaatgcaattgctcaagaagcactgggtgatgtgccttttaatttacttctacatactgccaaaaacgttctaaaatttgcactgacttttgaacttatcgcaatgattattcttactgttcatttttatggtgatgtttctttttttcaagcactgtatcaaagcctgttttacagtatttccgcttttaacaatgccggttttgcactgagttcagaaagtttaatgccttatgtggatgatattattgtcaatatagtcatcactggattgattattattggcggattgggatttgtggtactcatggatatcaaaaatcaacgccaatataaaaaattctcactaaatacgaaggtagtactttgggcaacctgtattttaaatatcgtttcctttctaatattttatattttagaacgacaaaacccgttaacatttggaccgctaagcgaaacaggtaagttgtttgccgcttggtttcaagcgataacaccaagaactgcagggtttaatactgttgatacggcaggattaactgatgccagtagtctgctgactatgttcttaatgtttattggcggaggttccttatccactgcaagcggtataaaaatcggcacattctgtattatagtggtagcgacattcgcctatttacacaaagaatcccatgtcaatttgtttaaacataatttgcctgatgaactaatcaaaaaatcctttgctttattttttaccagccttagttgtattggtattagtagctttttgctcttggcagttgaaccgcaatttcatttccttgatgttttatttgaagttgtttcggctttaggtacagtcggactttcacgaggaattactgctgaactttcaccgttcggagagtcaattttaattatcttaatgtttatcggtcgagtaggattgctcactatgatttatctcattatgcaaccgcactcaagtaaaattaaatatccaaaagaatatatacaaataggctaaaaaataaagggaataatttattcccttattttcctaaatttaatctgttttgcaccgcactttgatcaagtttaacgacaaatatacaaagtaattttcctctaagaatgaaaaaatttatgctaacaaagccaaaaactcattttcgctcagaatgttaataccgagctcagtagctttagttaattttgaccccgcactttcccctgcaataacaaaatccgttttactcgaaacactgccgctaactttacagcctaattgcaacaagtattcttttgcctctgaacgccccattttcgttaacgtaccggttaatacgacggtttttcctttcaaaggattgtcctgcacctctttaacctcaacgtcgtcccaatgaatgccttgtgcaattaaatcttttaccacagcaacattatgaggctcagaccagaatgaacgaatacgtttagccactacttcaccaacatcttgtaccttttgcaattgctcaaacgttgcattttcaaaagcctctagtgtcttaaaatgagttgctaaatttaatgcagtagtttccccaacttcacggatgccaagtgcaaaaataaaacgagccaatgtggtttttttcgctttagctaaacttgctaaggcattttctgccgattttgcccccatacgttctaaacgcattaaagtaacctgatctaatttaaataagtcagccggtgtatgtactaactccctttcaaccaactgttcaattaattttgcaccaatgccgtcaatatccatcgctttgcgtgaaacaaaatgtttaagtgcctctttgcgttgagcagcacaaattaagcctcccgtacaacgagcaactgcctctccctcaattttgctaataacggaatcacacacaggacaatttgttggaaaaataatagattttgcattttccggacgacgttcatgtaacacgccgataatttgcggaatcacatctccggcacgacgcacaatcacggtatcaccaatcgcaatatccaaacgtgctatttcatcaccattatgtaaagtcgcattactcacagtgactcctgcgacaaaaacaggttctaattttgctaccggtgtaatggcaccggttcgcccaacctgaaactccacattattcaaaattgtcagctcttcttgtgccggaaatttataagcaattgcccagcgaggtgctttagaaataaaaccaagttgttgttgcaagtcaatatcattaatttttaataccgtgccatcaatgtcataacctaaggaactgcgtttttgcttaatagtgcggtagaaatccaacactttttcaatcccatgacataattgaatttcattatttaccggtatgccaatagattttagccattgtaaacgagcaaaatgtgtatccggtaattcaactccttctgcaataccaataccataagcgtttaacatcaaaggacgttgaccggtaattttgggatcaagttgacgcaaagaacctgcagccgcattacgtggattagcaaatgttttttctcctttcgctaaagctgttttgttcagtttttcaaaacctgcttgcgacataaaaacttccccacgcacctccaaacgagccggtggattatctgttaataattgcaatggaatattacgaatagtacgaatatttgccgtaatatcttcaccggtcgtcccatcgccacgtgttgcagcctgtaccagctgaccgtttatatacaaaatactgactgccaaaccgtctaatttaggttcgcaacaaaatgtcaaagaacgatgaacatgtattaaacgatcttgaatacgcctaacaaaagcaacaaactcttcatcagaaaaggcattatctaaagataacattgggatttcatgtgttacttgtgcaaaattacttaacggtttcgcccctactctctgtgttggcgaattttcactggcatattcaggatattgttgttccaacgcttttaattgatgaaataagcgatcgtattcactgtccggaatttgcggattgtctaacacatgatactgatattcatgatgacgtaatgtttgtcgtaattcttcaatttgttgcttgatcataaaaattccttgcctcaagaccgcactttaaatagtggctcattatacacaatcacactattctgcgtaaaaaattgcccctgaaaatccagaggcaataaatcaatagaaaagtgcggtctatttttacaaaataatactaccgatcaatgccaaagcaaaaccgactaaaccgattaatgtttccatcacagtccaagtttttaacgtggttttggtatccatttccaagaaacgacttaccaaccaaaagccactatcatttacatgagaaagtacggttgcacctgaagcgatagcaatcacgataaaacataaatcaaattgacttaagcctgtggctgatgacaccattggtgcgatgagagcagaagttgtggtcagagcaacagttgcagaaccttgagctacacgaagtgcggtagaaattaagaatgccgcaacgataattggcatacccgtatccgaaaacatttttgctaatacatcaccgataccgcttgcacgtaatacaccgccgaacataccgcctgcaccggttaccaatacgattgcacaaatcggacctaaggcgttatcgcagattttttcgatttgttcaaaactgcgttgttctttgagtaaaatgatagtcattaataggctaattaataaggcaataggtgttttgccgattaagcgtaaactttgtacccataatgtagaaccatcaattacttttgctactgctaaagtgtttaggaccgtgtctaacataattaaacaaagcggcaacagcaaaataaataatacttttttgaaacttgggggattttgaaccgcagtttcgttaattggagctgcatttaagaaagttttcggtagcggtaaatcgaattttttacctaagtaaagcccatataaataagtagcaaaataccaagtcggtacagctaaaatgaagccgacaatggtgagcaaaccgatatttgcacctaaaatatcaccggaagcgaccggaccgggatgcggaggaagaaatacgtgggtgacagcaaatgcaccggcagcagggaacgcatagcggaataatgaaccaccgaattgttttgcaacactgaaaataatcggcaacattaccactaaacctgcatcaaagaaaatggggaacccgaataggaatgaggcgacacctaaagcgaaaggtgcttttttctcgccgaatttattgattaaggtatcggaaagtacttttgcaccaccggtaatttccaataatcgaccgatcattgcacctaagccgactaataaagctactgaggcaagggtattaccgaaaccgcctaataaggtcggcaggattttatctactgacataccggtagcaagtgcggttaataaactcactaaaactaaggcaacgaaagcatgaaccttaaatttaataatgagaagaagaagtaatgctatggaagcaatcaaaataaagatcaacataaaatttccctattaataaaattaaacagcagcaagcataccaccatcaacgaataacaaatgcccattaacaaaatcagatgctttagatgaaagaaaaacagtcgcaccgattagttcttcaggatttccccaacgggctgctggagtacgtttgcacaaccagtcggaaaattctttgttttctactaacggacgggttaattcagttttgaaataaccgggagcaataccattgacttgaatattatgacgagccaattctacgcacattcctcttgttagcattttcaccgcacctttagatgccgcataaggtgtaatagtgtctcgccctaattcactttgcattgaaccaatattgatgatttttcctgcttgccgtttcaccatatagcgagccactgtttgggaaacaataaatacagatttttggttgacattaatgacatcatcataatctttttccggaaaatcgcagaatgggtggcgacgttgaataccggcattattaattaatacatcaattgctccaatatgttgttcgatatgagcaatggcctgatgaacggcttgagtatttgtcacatcaaaagcaacagcgtgagccttatagtctttagcagttaattcatcagcaaccaattgacatttttcttgattagtaccatttataataacttcagcaccttgttcagcaacaccctctgccaataaacgaccgatgccacgagcagatcctgtaattaaaattcgtttattttgtaaagaaaataaatcacacatcttcttatccttatgcaaagttaagttggatttttgaaatttcatttttattgccagcacgttgaagagcggtttctaattgttcaaatggataaatttcagaaagtaagggaagcggattgattttacctaaacttaaccacttcacggcggtattaaattcctctacaaaacggaaagaacctttccagttaatttcttttgaaatgagaggcatcatattaaattgtggaattgagcctcccatcccaatttgtacgatagtacctttcgcttttgtgacagctaaacaacgttcaatggaggaaatatgacctgaagcctcaaatgaaacatcaaattcgcctttgttttgtaaatattcggaaaaatttccttcagtggcatgtaatacttttgtagcacccatttctaatgctaaatctaaacaacgctgactaatatctgaacagatgatttctgctgcacccaatgcttttactgccgcaacagctaaacaaccgataggaccgacaccggaaataaacacttttttcccctgcaaatcaccgccttgttttgctgcgtgaatagttactgctaaaggctcagcaaataccataacctcatcggaaacttcttgcgaataaggaatacattggttgttatctacaattttatattgagtaaaaccaccatcaacgtgcggattgtacattgcactaccaaaaaaacgcattgtttcacattgattgctatagccacttaaacaatatgcacaacttaagcaaggtttgcttggattaattgcaaccttttgtccttcaaataaattgggagcgttggtctttacaattttaccaattatttcatgacctaaaatcatggggtgtttgattgcaaaattacccactttgccatgttcgtaataatgtaaatctgaaccgcagatactgccacgagtaatttgaattaaggtttgatcttggctttgttcatcaaattcaatttcttgagaaatgacatcaacagattttgctcctttaactacgcaagataacgtgtttattttcataaaatatcctccaatatttctgttactggtaacatatttatttttctagattgggtaaagtttttgtgtttgattttgtgatttacgtcacattttttctttatttttaatgatttttaaaaaaagtgcggttataaaaataaaaatttaaaacaataaatatagatttaagtgttattggtaactttttaaatttttttcaggtacactaagctcaatagcgtgtttattagaggaacaaaaaatgtcaaaaggaaaaagtattattttaatgggggtatctggtacaggtaaaacatcagtaggaactgaagtagcgtaccgcctaggattgaaattaattgatggggatgatttacacccaagagctaacattatcaaaatgagacagggacaaccgctcaatgatgaagatcgtatgccttggttggagcgtattcgtgatgcggcatttagtttggagcaaaaaagtgaaaagggcattattatttgttcagcactgaaaaaacaatatcgagatcaaattcgtgatggaaaccaaaacattaaatttatttatctatccggcagttttgaattagtgctttctcgtctgcaaaaacggcaagggcattatatgaaaactgaaatgttgcgaagtcagtttgctacgttggaagttccccaagctgatgaaactgatatttatcacattgatattgacgcaacttttgaggaagtagtgcagcgttgtgttgaagctatcaagcctcttttagattgatgacaagaaatgcttgggcgtagaggcgttatctaagacgtagattacagacaatatttttgccataaaagatagtttttgagctaatgctacgaaaaaatactcaaaccccaccgcacttggtcagtacagtggggttataaatagaaaaagcgtagtcgatttttaccagtatgcattgttattcctatgttttgttttaaaaataaaattctgcgtggtgtattattgacaaggcgttgtacaaaacaattcaagcgaaattcccacctttgcagtaaaaatttaattctcttggtgttattcttgtacgatctattctctctatatttgcatttttcctaaagcaaaactcgatctatctcacaaaaatattaacaaataatttacaattcaaaccgagcatgctaaaaagcaatcgtttgcaataaaaatattgcatacattgcatacaatacaacatcaatgacatcacacaggagcaactctatgaaaaaaatgaaagtcgtattgaccagtgcaacagttctacttgctacattgcttgccgcttgtggtgataataacaaagcgtcgaaagatgttactgcgagcaacgttgcggcaaacagcagcagtgctgaaagtgaggtaccagccacagtgcaaagcaaatttgtgaccattgctactggcggtgcttccggtccttacaatattattgcgacgacactgacaggtatttatagtaaaaatctaaaaactaattccaaaacacaaactactggtgcatcggtagaaaatttaaacttgatggcacagaaaaaagtggaaatggcgtttgtgatgagtgatgcgttaaatgatgcgttaaatggtaccggcagtttcaaaaataaaattgagaatgtggaacaaatagcagcactttatcctaactatgtacaaattgtcacctctaaacgttccggcattaaaaccattaccgatttaaaagggaaacgggtagcgaccggcgatcaaaattccggagtcgaagtcaatgcacgtaacttacttgccggttttggcatttcctatgcggatattaaggttgattatctcggttatgctgcagcggcagatgctctaaaagcgggaaccattgatgcggcgttcttaaccagtggcttgccaaattctgctttaatggaattgcaacaaagttttgatctgcaattggtctctatcccggctgacggaattaaaaaattagctgcagataaaccgtattttaatgcgatggatattccagcgaacacctatggcaatcctgaaccgattccgacagcggcaattaaaaatgccttggtgatccgtaaagagctcagcgaagcagatgggtatttattaaccaaaaccttctttgaaagtttgccacaattgcaaaccgcacaccaagcggcgaaaggcattaacgtgaaagaagcacaggaaggtgcagttgcaccattacatccgggtgcaaaaaaatattatgacgaagttaatgcgaaataattcgttattaagttggtaagcatgaagataatgcctcgtaacggttggtttgtgctggtgccactcgctgttattgggctttatcctgttcattttatatcagttaccacaaaacaaggcgaatgcatcattggtgatgatcattttgcactacgttggcgtcactccgtcgagcatcaattgtggtatgaacattatcaacgacaaggtgataacctccacctttatcaaacatggttacaaacatttggtgctggaacaccttctcaaggtgaagttgtcacccatgtgccagtgggctatgtcggttttaaacaagatgttgttttacccgaaataaattggattgtttcgcatcgtatggaagggactattttgcttgatgataaacaatttcccgtttatcaaacacttcctaattattctgcggtaacaatcgaaccagctaaatctgtaattgcaacgttgtggttaaggaaatcatgttatgactgattctgtaaaaattgacaccgcacttggtgccaaggaacaagagattttggaaaaatatgaccgtgaatcggtcactcgtcaatccagtagccaatttaataaagggttaattacgctggtttcggttttatattccctttttcatttatacaccaccttttaccccctaccgacgttaatccagcgtgcagtacacgtgggcgttggagcgatattaatcctattaatttatccggcatcgaaaaaacgtcgccaaggttctgttgcatggtatgactggttatgggttattgccggtacgagcggtatgctgtatctcatcaaccaatacaatgacattatgaccgtccgaggtggtattccaaatagcacagatattgtgatggcaatcatcactgtgctagtggtgcttgaggtaacgcgtcgcgttaccggttggattttggtgattttttccttgctcttcttaatctatccattcatcagctcaatggattttatgccggacagcctcctcactcgcccttatgatgttggtgatatttttggtcagctttatttaaaaaccgaggggttatattcctctgctgtgggggcttccgtttcctttattttcttatttattttatttggtgctttcctaagtaaatcgggaatggggcaattatttaatgatttagccttagcgatcgctggtgataaacaagggggaccggcgaaagtagcggtaatttccagtggctttatgggcagtattaacggggcagcggttgccaacgtggtgagtactggagcgtttactattccattaatgaaaaaaatcggttatcacaaaaactttgccggtgcggtagaagccagtgcatccgttggtgggcaaattctcccgccgatcatgggagcaagtgcattcattatggcggaaacgacaggcgtaagctacggaactattgcacttgcagccttacttcctgccttactttactatctcggcgtcattgcacaagtccactttcgtgctggtaaacaaaacctaaaaggcgtccctaaagatcaattgccaagggtaaaagcagtgatgaaagcacgtggtcatatgctattgccaatcttagcccttatcatctttttggcacaatccgtaccagtaggatatgctgcctcttatactattgtgcttaccattttagtcagtcaattgcgtcaagaaacccgtatgggcattaaagatgtaattgaggcattggctgacggggcaaaacagtcgctttccgttatgtcagcttgtgcgacggtaggaattgtgattggcgtgatgaaccttaccagttttggtacagtgattacctcttctatcgttacattaggtgcaggatcgctctttttaaccttatttttaacgatgattgcctccatgatccttggcatgggactaccttctattccagcatatatcattaccgccaccatggcagctccggcattggcaacctttgatgtcccggtattagtggcacatatgttcgtcttttattttggtattttcgctaatatcacaccaccggtcgctcttgctgcttttgctggtgcgggaattgcacaaggtgacccaatgaaaaccggctggcaatccttgcgtctagccctagcgggttttattgtaccgttcatattcgtttataatccgaatatgctgatgattgatgttaccaatgctgcggttattgccaaaactttccctctaccaagtgcattcgaaattattaatgttatcgtatcctctgttattggcgttttgggattatctgctgcggtagaggggtatctgaaaaatactataccaatatggcaacgtattattttagcaatcggttcgcttatgttgattattccggaatggatcacggatattatcggcattgctgttgttgtagtcatagcactacttaatgttcgccaatgtgactaacaattgttctgtgcatacgataaatgacataactaaatgtctaattaacttttttagatttgaaccaatcattaccccttgattttgcatagcttcacaaccggttgtggcggtttgggtgttagaatgtaatgaaaaaggttatttcccttaacacccaaaatactcaaaccccaccgcactttgcaagtacagtggggttttttgttgtgtttcagcaagtttgacaaattaccactgataacctatcgacacggcaccggatactttgccttgggaattgctattaccttgcagtttcagcataaccttaccgttatcgctgatgcgagaataaccaatcgccaacgcactttcgccatcatgtcctgccgccgcaatcgcaaccatggacttgcccggcatagagactgatgccaatgccgccgccgcattcgctccggcaataccggcacgcaatcggcgatcggcatgatgtatttgtgtacgtaacgcattattttgaccatccacgtagtttttattgactgcaacaaatccacttgcatcaggtttgacatccggaattaaaatttccccacggttaccattgatgacgatattaccgttattgcctgataccatcaaccctgcatgggttgccatcaatgacggttcagcggctttgccttgtagcttaatgccatcgagggtgtaacttgctgattgaccggcatgatttcctttgcccataatacgggtaccctgtgccgtcactaccgcttcgctgtctggactgctcactttcaaaccgttgctgttcaacaccgattttttgccattgatttcacgtgtctcaaaagaagtcatgtttttcaactggtcagacaatttaacttctaagcctttgccatctgtttccaccttgatattgccggcagcggtgaggttgctgttaaacgtatcaccttcacctttaattgctaaggtttcgcttaatggcgtacgaacctccataccatcattgccyttraacttcawkccsgatttagcyaccgcttgcacgtcagcaatggtggctacgttggttagatccgcttggctatcaggtttcactaagtcagcaactttatcataacccttgtagttggcttcatagtcagcattggcttytgttaattctgtctgagcctyggttaaagcagtttttgctttccctagctcttctttagctttttcaagctgtttcttgttttcctcyaattgagtttgaagtttctttttatcctcaccctcaggcatggcactcatcgccatttctaaaccgctcacrgctaaagttaaatcggttactttttgggctgtagttgaaagttctttcgctttatcgcctattgctttcactttttcctcaacagctttggtgagtkcagtcgctttctcttgagcctcttttgctttrrcykgatcagtttcaggrkcwgsyagtcccaaaccactcgccacgttattcatcccgayaggtgcggtwgtcggctcggcacgaataatcaccttatccgactctggtgtcacatcttgcccatcttgwgcaatgtattttttactttttgcatcatacttcgcyccctctaaatctttaggatcatagaacttaccatcacgtcctttgacaactttggtatagtcatcgccctcttggatatagaagtcaaacggacgattgctgtctaagtcggatactttttcatccacatagtttttattcgccgcacttgaaccgtcagccgtggcatctaggtctttcaagcccatgattacgcctgtacccgatttaccgtcagtgcctttagcaaacgccagcgtagctcccttgccatcttgaccgtcctcaccgtcagccactttcaagctcacgacatctttaccagccttgtccttaatagcaacctcaccggcttttacctcggttgtgtgcttgccattgcttaaaacattcgcttccgccgtctgatcattgaccaaaacctgatcatcgctgaccacagacattgtcactccctcagccgttgtcaccaccgctttttccttatcgggatctgtattatccgtgatgatttgcgatgtcgccgtttgtgtatgagcgttacctgcctgatctttcaacacaatttcattgccggtaatgtgagtcgtgttaccgctttcgccgttaaactcrgcagatttcaarcctgtcaagtcctcagtcgtaccaatcgtcaccaccgcwgtrgtgttcgakgttktgcttggtgtactgcttgctgtgccrgctgttgtcgtacttggagcagaacttgttgaagatgtactgcttgtaccacttcctccatctgtacctgcaccagttgacgaagtcgtgcttggagtgaacgtactatctgcccctacactgctatttgatacagtgtttgtcggtgcggttgtcggagttgtactgcttccgacagttgcacctgtaccttgtgcagccatatttgacgagccggacgtaccwgcygaagyygyaccatttccacckccrrcggtacttgcaccacttgcgagtgcagaacyamccgcacttggttgtgtagtaccattttgagctaactctactttaatattcaraccrgcattaaacttcaacgtatcgyyrcgaccratttgataagttgtaccatcaccattcgccacattgaatttaaagctatytaaygcttkttcaagrtargacttggtgattaagtcgttatcttccacccctttattaccataygtttgagcttgwgataargtmactttrctaaatktcggtgcgtctttaaacccgatttcgattttggcgttgccgttatcataagtgtattgagtaattaggtttttaccgctgtaannnnnnnnnnnnnnnnnnnnnnnnnnnnnnnnnnnnnnnggcgtacccaaacgcacaatattaatgcttgagccgagatagtgggtgccgttatttgtacctgttggaacatcascrccraacktyaarccmkcgtttaacttcgctcttgtttcgtcaatggcacctttcaatgaggttgggttcttcgctttgaatgaaccgtccacattagacagatattcaaagattggagcagtaaatttcgttttatccttatyaacmkcaayrcctaayttwyycgctaaatctgccagttgtttacctgtwacrgcktcttttgaakyytyagcaatttcaccstctgmaakstytttkarttttgmatcattaaarytratttctttyttagytktkyctaamgtgattttcgcmccywtktcatctktaccaccscwratactstytayatctttaagattrttmgccarattatgttgaattgaaccattytyrkctacwwygacttswatrttgtcattttyacctttcttaaagtccaagccatccgttartttkacggtttgcttatttgtgctattagmtttataggwyawkktyaawtcatcmacatakttyttattgacggcatcatakytatctgttggatcagcaacataaacaattcttcttctgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcagaaagtttaacggatttctccccagtgccttttaggtagtcgactagggctttggcttgtactaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatacctttattaacagccgtgattaaatcttcaattgcacctttgaatgttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttccatcattaaatgtaatacttccatcatttaaagtacttatagaagttttacttttagttatggcaccatcaagagcttttaaagcgtctcccactgtgttgtatgactttgtaccactaccattagttaatgtataagtcggtcctgttacagttccgccatctcctatcttagatcctccacctaaagctgttacaacagaatttaattgtgatttattagtagcgtcgttatcatctattccttttgcaatatttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacatattttttagttgttaatacattgtctttacttgtatcttttacttcttcacttactgttacttctttaaagtttggattttcttttatacctattaatatatttttatttcctttttcataatgtgtcctaatattatcacttaaaaatttatctgttttctttgtttgtttatcttcaactgttatagtcccagcttttattatcaagctatctcctaaatagtgtgttcctttttcttcatcactatctccagctccaaaaataaaaccttcattaattttagcaatattatcatctatcgcttttttaaatgtttttgctgtagctggtgttgaagcagtaatagtttttcctattaattgcttaaattctgattgtttaaatcctttagttgcatctacttctgctcctaatacatttactcctaaattgccaaatacatctattacactatataactgacttccatttattgcatctgttgaagtagcacttatcgttcctggtgctacatgtttaataagacgttgttttcctgtatctcctatacttaaaactgatttattagttccatgtccactaaaactagtaaatttaagactatttgtatctgttgtatattctgaatctgatttttcttktttwgtygcttywgacccttkmcccaacgcaatggartyscyrgcgkcggtttytactgttgcaccttgtccaatcgctactgcaccgacggcgtttgtctctgctttagcactatgaccaataatcaccgcactttttgcacccttgccggcgtttgattttgccccaataagcacactttcttttgcagtttccgctgtcgcaccattaccaatcagaattaattctgtattcgcattctttgtaccgtttgtctcctcattcgtctcatccaatgctttaatattgttccctaacgccacaatatccgtaccgtttttgattttgtttttattaccgatagacgctgtccatgctgcatattcaattnnnnnnnnnnnnnnnnnnnnnnnnnnnnnnnnnnnnaccgcaccgatagcgatagaactttttgattctactaattttgttccgctaccgatcacaacaaccgcaccatttgtctctttaaagctttgcgtaactgtattattagaccccagcacaaatgaatttggtacatcaatactaacatctctacctatcacaaccgcattttctgctnnnnnnnnnnnnnnnnnnnnnatagcgatagcaccttcagcttttgcaccgtcattattgtaattgctttttgactctgggcttgtcggggctttaaccgataaaaagtgcaattttgaatcttttagttgtttaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattccctaatgcaattgaggcttgaccaatggcacgcgtaaaacttcctattgcaaaggaatctttttcttttgcaaatgaaaatctcccaattgcaatcgcactatcttctttggcgtaagcatatctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccatacgccgcactcgataacagcccactcatcaccaacgccaacggcagaaccttaaacatgccgaaaaacacaccgcacttcggctgacgccccgacgctccctcaacacggctcgccacttggcggttattcgctaattcagacaccactttggtttgtccagttgttacatcgtatttggttttgaagattttgttcatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgaaataggatatttttaagatgttgtttgaacatatccaacctcacaaattcaacttgcaaggttgattttaaagaataaactacgctgtagactgtagactgtagactgtagactgtagactgtagactgtagactgtagactgtagactgtagactgtagactgtagactgtagactgtagactgtagactgtagactgtagactgtagactgtagactgtagactgtagactgtcattttttccgttctatttttttgttaagtaaaagtaaaatttgtcgtattttatcttgtatttatttgtaagaaaagcgtaaattaattattttaatgtcggggcggattatatccgctctttaatgttttgtttaatgtgtttggttttctattcgggttttgacttgcacctcaaataaaattcggagaaaatatcggcttttagtcagtataacaaacgatcatgtcatattctcaacaagtaaataaacgtcgcacttttgcgattatttctcaccccgatgcggggaaaacgacgattacggaaaaagttttactctatggaaacgctattcagaaagccggttcggtaaaaggcaaaggttctcaggcacatgctaaatccgactggatggaaatggaaaaacagcggggaatttctattactacgtcggtgatgcaatttccttatcatgactgcttggtcaacttgcttgatacaccagggcatgaggatttttcggaagatacttaccgcactttaactgcagttgacagttgcttgatggtgattgacagtgcaaaaggggttgaagaacgtacgattaaattaatggacgttactcgtttgcgggacacgccgattttaacgtttatgaataagttggatcgtgatattcgagatccgatggaattgcttgatgaagtggaaagtgtgctgaaaatccgttgtgcccctattacttggcctattggttgtggtaaattgttcaaaggtgtttatcatttgtataaagacgaaacttatttatatcaaagcggtcaagggcatactattcaggatgtgcgtattattaaagggttaaataatgccgacttggatagggaagtgggcgaagatcttgctcggcaattacgtgatgaattggaattggtcaagggggcgtcgaatgaatttgatcatgatttatttattcgtggggaattaacgcctgtttttttcgggacggctttaggcaatttcggtgtggatcattttcttgatggcttgacacaatgggcacccgctccgcaagctcgtcaggcggattgtcgtttagtcgagagtgcggaagaaaaattaacagggtttgtgtttaaaattcaagctaatatggatccgaaacatcgtgatcgggtcgcttttatgcgaattgtttcgggtaaatatgaaaaaggtatgaaactgaaacaggtgcgtttggggaaagaggttgtgctttccgatgcactgacttttatggcgggtgatcgttctcatgcggaagaagcctatgccggcgatattatcggcttacataatcatggcactattcaaattggtgatacctttacgcaaggtgaagatctgaaatttaccggtatccctaattttgcaccggagttatttcgccgtattcgtttgaaagatccgttgaaacagaaacagctgctcaaaggcttggtgcaactttcagaagaaggtgcggttcaggttttccgtccgttaaccaataatgatttaattgtgggggcggttggtgtactccagtttgatgttgtcgtttctcgtttaaaatctgagtataacgttgaggcggtgtatgaaaccgttaatgtggcaacagctcgctgggtagaatgttcagaggcgaaaaaacttgaagagtttaaacgtaaaaatgaacagaatttagcgttagacgggggagatagtcttacttatattgctccaacgatggtaaatcttaatcttactcaggaacgctatcccgatattcagttttttaaaacaagggaacattagtctttgatatgatagacaaaagagcggagatatttccgctcttttttgttgttcaaataggaaagtttgctcggtttaaatgcggtttaaagcgttgtgcctattttcaactcacattaatactcttgaacttcttcgtgttttcctaccgcacttttgatagttaattgcacttcagtagaaataattctatcgagaatatcgctaatgtcatttaatttctccgttatagcgacgccatttttatcaaaatatccgttggatcttaagctaccgataaaagcggaaaagacggctttatcgaaaaattccggtgcattaatgccatgtaatacagataaccgctgtgcaatagattggctttctttctctaaggtcgctttggcaatattcggggtatcttgcaagatactgacggtaatataataacgttgtaaaatttctcgaactcccgccatccataactgtaaaactcttacacgttctttattgattgaaagaagattttctgcacacagaattaatttttgacgtgtaaattcctcaataattttttcaacatattcatctaattcatcttgtgaaaagtgtaaaaataattcctcttttaagaaagggtaaatttttcgagctgcatttgataccaactctttttgtattgcaccatgatgaaaaatgatacttgcaattaaagaaggtaaaacaaaaacatgttggatattattacgataataggtcatcaatactgctgctgaacgttctaaacgcaacatttcaccaaaattatctttttctacgataagtccgactcgttctaagtttaatacatgagtgagcatttcttccggtgtatcagtcggtacaataatatcgttggaataaggggcgtgttgtaaaaagcgttgataacttttcagttgttccaacagttgttcacgagataaagcacgttggcgagaagacaaaagtgcggtgcccgttaagttcattgcattaattgccgctgctttgttgatattgatcatgacttgatttgaaatggcattaactgcagggttaaaccattgagaatgatcttccggctggctatctttccattcaggaaaatgttgatttaagtaattacttaatgtgataggttcggcaaaatttacataaccttgccctaaattgcgtaatttgcggataacacgcaagaccaaaccggcgttttctttctcttttgccgccccccgcaattcttttgcgtaagtatctacctctaatacatgctcatagcctacataaaccggcacaacggaaattggtcggatttggttttgttgtaaggcttgtacagtcatagacatcatacctgttttcggggcaagtaaacgtccggttcttgagcgaccgccttcaataaagaattccacagagtagccacggtgaaataattctgctaaatattcacggaaaatggttgaatataatcgatttcctttaaaggttcggcgaataaagaatgcacctcctcgacggaacatcattcccaccggccaaaaattgaggttaatacctgcggcaatatgtggaggcaccaacccttgatgatatagcacataggacaataacaaataatcaatatgactgcgatgacaaggaatatatacaatttcatgtccttctaacgctaatttacgtacacgttctgcattttggacatcaattccttgatataatttattccataaccagcctaaaaaacgatctgcaacacgcaatccctcgtagttcacattggcggcaatctcatccaatatcttatatgcttctttacgtgctttttctttgctgattctcttacttttcgcttcatctgcgatggcattgagaattgccggtgattgtaataatttattaaacattgcttggcgattaggtaagcgaggacctgtagcggacattctttgtttggcaaaatggatttttgccactcgagcgagttttaaagcaatacttgcatctgttccatattcatcagccatatagcgtaaagaaaccgcttgtgaaaaacgcacaaaagtatcacgcccaaaccaaatagccacagctgttttttggatactatttaataaacgaagttttggtaagccaacctgcttttcatgacccggagaacgtccccaaagtacggaaacaggcactaactgtacatttaaatcaggtaaagagcggtgtaattcaaggtatttttcaactatctgaatagtcgctgacttagcacctttcgatttaaaaaaacgtctaccttcgtctaaaaatacataacgaggtaaacattgcccccccaattcattctcttctaagggatcaggcaatcctacgcttaagcaatttctacggataataattaaatctgtttgtgaagtgtaaggtaataaataaatgatcggttggctaatatctaatgataattcttcgataggttgttgcggtatagggttatttttaactaaaaaagagagagggacggacaaaagattacgataaaaattaagaatacttgacataacaatttccattaacttattaggttgattggctaatgaatactattctaacaaaaaaaatatttttttattaataaattaatttattgaaactaaagattgatgtaattttatttctgtatataatgtcatatattctgtatataaaaacaggggttagtatgagttcaataaaatcattaacgacacgacaacaggaagttttcgatctaataaaacgtcatatcgaaagtacaggaatgcctccaactcgagtggaaatatctaaagaattgggatttcgctctccgaatgcggctgaagaacatttaaaggccttggctcgtaaaggtgtaattgaaattgtatctggtgtatctcgtggtatcaggctattaacggatatagaagaaccggaaaatgaaggacttccgctgattgggcgagttgccgccggtgaaccaattttggcggaacaacatattgaagcaacttatcaagtcgatgctaatatgtttaaaccgcaagctgactttttattgaaggtttatggtcagtctatgaaagatattggtattttagatggtgatttgttggctgttcatagtacaaaagacattagaaatggacaaatcgttgttgctcgaattgaagatgaagtaacagtaaaacgctttgagcgtaaaggttcgattgtttatttacatgcggaaaatgaggaatttgagccaattgtagtagatctaactcagcaaccttactttgaaattgaaggtattgccgttggcattattcgcaataatgcttggatgtaaacatgacatcatgcagtaaatttgttatttaaaaacgagtagcggaacaaaaataagccaacaactatttgttggcttatttttaactatctagcataaatctcagcttcggcaaaaaaataggcaatttcacgttgtgcattctctaaactatccgagccatgaacggaattttgggtttgattaatagcaaattcataacgtaatgtgccattttctgctatttccggattagttgttcccataaaagtgcggtagtcttttaccgcattttctttttgtaacaccaaaacaactataggggcagatgtcatgtatttaaccaattcagtaaaaaacgctttattgcgatgttctgcataaaaaccttccgcctgttcttgatttaaatgcaacatcttcatagcaatgatttgaaatcctttgtcctctaaacgagaaatgatgttacctattaaatttcgttcaactgcatcgggctttataatcgctaaagtttgttctaatgtcataggtctctccattattcagctttatttaataaaaaattcgccaaagtttgtacaccgattcccgttgcacctgttgcccataagtcacttgctgatttacgataagttgccgaacaatcaatatgtaaccaattttcttgataattttctacaaaataagataagaatgccattgccgtacttgcaccggcacccattggaacagtcccaatattggcaatatctgcaaaggatgaactaatttggtgacgatgtaattcgtcaaaaggcaatcgccaaaacggttcttttgtactctttgcacaatcgaaaaactgttgagtgagttcgttatccattgaaagtatcgcatgataatcattaccaaccgctacttttgctgcaccggttaaggttgcgcaatcaagaataaatttaggcttcgctaaatccgcatcaattaagccatcggcaagtaccaaacgcccttcggcatcagtattaagaatttccgcactgataccattgcggtagtgaataatatcacctaattttaaagcgttgtggctcaccatattttcagcacaacataaaaatagtttaactcgtttgttaagccctccggctattgccatacctaatgcacccgttaatagtgcggcaccgcccatatctgttcgcattgtactcatgctatcacttggtttaatgctgtaaccaccactgtcaaaagtaattcctttaccgactaaacaagccagtaccggtgcattttcatttccggtaggattaaaatccagctgtaacatagctggtaaattttctgagcctttacctacttgccaaatcccttgatagtttttttcagcaagttcttgtccggaaataatttgaaaagataccgcactttcgtcagcataaagacttgcttgttcggtgataaattgtgccgcacgctttgcaagttcaataggggtgataattgaagaggggagattaataatttcacgcacaaaatcgccacattgaattcttgccagcaattcagcttgtggctcgtcctctaaatgaggaaattcaatagtataatcttgtttagcggtataaaagccttgatagaatgcccaacaattttctaaatcccattctgatccaataagttcaacttcttttattccttggttgcgtaattttcgagcggctttttgaattaaagaaatgtcttggttacgtgtcggatgatgaatgatggcttgatcgtgagtaaaactgattaaagcttttttcccccattgttcttttgctggtgaaatttctatcttaatttgcatactttatccttaaatttacttgataaaaaaactgatatagatggcactataccagtttttattgaggtaacaagaatgaatagggagaatgatcagaaataaagtctaattagcgtaaaaaagcaggaatgtttttttcatactctgcgattttatcttcatgttgcaaagtcaatcctatattgtccaatccatttaataagcaatgacgacgaaattcatctaattcaaaatgataaattttatttcccgttgtgacggttaaattttctaaatttacatgaatttcacaacctttatttttccatacccattgaaaaatttcttccacttcttcttcattcaaacgaatgggcaacatatgattattcaggctattattatagaaaatatcagcaaaactaggtgcgatcatgaccttaaatccataatccgccaacgcccaaggtgcatgttctcgagatgacccgcaccctaaatttttgcgtgcaagtaaaatcgttgcaccttgatactcgggaaagttcagcacaaatttaggattaggtactgtaccttcctcatcaagataacgccattcgtggaataagtgttttccaaaacccactctggtaatagcttgtaaaaactgttttgggataatcgcatcagtatccacatttgcggcatcaagaggaaccactaaacctgaatgttgtttaataccagccataaatcttccttaatttaattccatataacgaatatcaacaaatttaccgaagacagccgctgccgctgccattgccggacttacaagatgggttcgtccgttacggccttgtcgcccttcaaaattacgattactggtcgaagcacaacgctcccattcaccaagtcgatcatcattcatacccaaacacatagaacaaccgggattacgccattcagcaccagccgcaataaaaattttatctagcccttctttttctgcttgttctttgaccaatcctgagccgggaacaacaagtactcgttttacgttatccgctttttttcgacctttcattactgtagctgccgcacgcaaatcttcaatgcgggaatttgtgcaagatccgataaatacttgatcaacggaaatatcttttaaatcagtttccggagataagccaatataagctaaggctttttctgcggaggctttggtgacgggatcttgcatttctgccggattaggtactttctgatcaataccgataacctgacctggattggttccccatgttacttgtggagcaatgtcttttgcgtctaatatcaccacagtatcaaactctgcaccttcatcggtttttaaggttttccaatattctaccgcactttcccagtcttttccttttggtgcataaggacgatctttcaaataagcgaatgtggtttcatcaggtgcaatcagtccggctttcgctcccatttcaattgccatattgcaaactgtcattcgtccttccattgacaatgcacgaatagcttcaccacaaaattcaacaacatgaccggttccccctgccattgtggttttaccgataatggcaagaataatatctttggcagtaatgccttttgcgacttcgccacgtacttcaattttcatacttttggctctggcttgttttagtgtttgcgttgcaagaacatgttccacttccgatgtaccgataccaaaagctaatgcaccgaaagccccatgagttgccgtatgggaatcaccgcaaacaatcgtcatgcctggtaaggttaatccttgttccggccccataacatgtacaattccttgctgtttactgttcatatcaaacaaagaaattcctgttgctttacaatttttatctagctctaaaacctgaattttcgcttgccctgttaatttgtttacatcacgcacttgagtagaaatactatgatccattgtgccgaaagttttattcacttgacgaacctgacgacctgctacacgtaaaccatcaaaggcttgcggtgaagtgacttcatgaattaaatgacgattaatgtacaaaatcggcacttctcccggtgcttcatgtacaatatgagaatcaaataatttttggtagagtgtttttttcatatttattccgttaagtttttttcactaattaggtaagtgcggtagaaaacgagaaattttggctaaatttaccgcactttatttttcattctctattgcttaaattgcgtttacaattaagtctcccatttcagctgtggaaattggcggatgttcatctgctaaatctgcggttcgataaccttgagaaagaacctgtttcactgcattttctattgaatccgccgcttcatttaaattaaagctataacgtagcatcatggcagcagatagaatttgagcgattgggttggcaatgcctttgcctgcaatatccggagcagaaccacctgccggttcgtaaagcccaaaaccattttcatttagactggcagagggtagcatacccattgagccggtaatcattgccgcctcatcagaaataatatcgccaaaaatattagagcaaagtaagacatcgaaaaattcaggttgcttgatcaattgcattgtcgcattatcaatataaatatgatccaatgttacgtcaggatagttcttggcaacctcattgaccgtttcacgccataataccgagctgattaatacattggctttatcaacagatgttacatgtttacgccgtttcatcgctgtttcaaaagcaactttagctatacgttcaatttcatatttgtaataaacttctgtatcaaaggcacgagtttgcattccctctccatctcgtcctttaggttgaccgaaataaatgccgccggttaattcacgaacagtcatcatatcaaatcctttggcggcaatatccgctcgcaatggacaaaatttttctaaaccttggtaaagtgtggcaggacgtaaattacaaaacaatttgaaatgtttacgcaatggtagtagtgcacctcgttcaggctgctgattagggggtaaatgttcccattgtggtccgcctaccgagccgaataaaattgcatcactttcttcacagccatttaatgtagaagcgggtaaaggcgtaccatgattatcgatggctattcctcccacatcaaaagtgcggtaatttaatttgaaattatattttttttgcactgcatccaatacttttatagcttccgccataatttcaggaccgataccatccccacttaatactgcaatagtataacttttcatgatttttcctctttacatcaactttactgtgaaattttatgcgattttaaatctgccactttattggcacgataaattgcattgattgcatgaattaaggcacgagccgaagattctacaatatccgttgccaatccgacaccatgaaaacgtcgccctttatgttcgacgacaatatccacttgtcctaaggcttctgctccctcaccttttgcagtcaggttataatgcaacatagttatatccatatctgtaattgctaaaatagcgttataaacggcatcaacgggaccatttcccccatttgaaacttggctaatttttttaccgtccagttcaacttgcacaaaggcagaagccggtaaattactgattgtttgagaagtaataacatccaaacttagccgatcttcatcaccctgttgcatatcaataaatgccaatgcttccaaatcataatcaaatacttgcccttttttatcggctaattttaaaaatgcggcgtataatttatccaaatcataatcgttttgttgataacccattgcgtccatatggctttttactgcagcacgtcctgaacgagcggttaaattcaatttttcttttttcaatccgatggtttccggcgacataatttcgtaagtatttttatttttaaccataccgtcttgatgaatacctgaagaatgtgcaaaagcatttgatccgacaatagctttattcggctgaagtggcatattacacaactggctaaccatctgactgacacgatgaatttcttgtgtattaattcgtgtatctaagcccttaaatatatcttgacgtgttttaattgccatgactacttcttccaatgcagtatttcctgcacgctccccaatgccattaatggtacattcaatttgtcttgcaccgttttgtactgcggtcaacgaatttgcagtcgccatgcctaaatcattatggcaatgcaccgaaattactgctttatcgatattcggtactctgttcatcacttgatcgatgatattaccgtattcggttggtaaacaaaaacctaccgtatccggaatattgactgttgttgcacccgctttaattgctgcctcaacgatgcgacaaatgttgtcaacacctgttcgaccggcatcttcgcaggaaaattccacatcatcggtataacgtctggcacgttttactgcttgtattgccatttctacgacatcatcaaaagtgcggcgtaatttagcttcgacatgcaaagcggaagtggcgataaacgtatgaatacggaaagcttcagctacttttaatgcgtcagccgcaatatcaatgtctttatccactgcacgggataaggcacaaacacgactgttttttatatgacgagcaatggtttgaacggattcaaaatcccctgctgacgatactggaaaccccacttccattacatcaacacctaaacgttccaacgccaatgcaatttgtaatttttcttttactgttaaactggcttttaatgcctgttcaccatcacgcaatgttgtatcaaaaataataatgttgttttgcataactctttccttcttattttgtatgttgccatctgcaaagtgcggtgcttttttattgattttagatacaaaaaaacccgcattctacttgtgcgggtcaactgacatgtttaactatacttctttgttccacaatttatccgcacaagaaatgtgatagtcgtaaattgagtaacagagaaagaatgtcaaacataaaatatcctaaaaataaaccaagatgggtttatattacgagtttaaaatgatgtgtcaaatgattttttagtgttttataccaaataaaaggttattcaaaacataagtttaatacataaaactaacttttaataatttaatagtgttaaaatccacatcgttaaaaaattttaattttttctaccgcactttagctctttcatagtaatgaaagtaaatttgtgtttttttgggggttctaaaaaataacttatcggcgttctttgagttgattttgttttaaatcaaataatcctatcatatacaactaaagagttatgcttttaacgtttcattttttacaccatgagtatagcttatgatagaatgcgtctccgaaaatgtttaaataacttcttatgcaaaataatcatctacaactggaacaacttgcctgtcagcgtggcgataagattttgtttactgacttaaatttagatgctaagtcgggagattttgtgcaaattgaaggacataatggcataggaaaaaccagtcttttacgaattattgtgggacttagtttccctgctaaaggtaaagtgcgatggaataagatcgaaattaataaaaatcgtgaagaataccagcacaatttactctatttggggcatcttgctggaattaagcctgaattaagtgcttgggaaaatttacagttctatcaaaaaattggtaattgtcgacaaagcgaggagttactttgggatattctacagaaagtggggttattaggtcgagaagatttacctgcaggtcaactttctgcaggacaacaaaaacgtattgcattagcaagattgtggttatcaaatgcggcattgtggattttagatgagccttttacagctattgataaacaaggtgtcaacgttttaactcagttgtttgaacaacatgtggaaaatggcggtattgtgattttaaccagtcatcaagagattccgagcaataagttgcaaaaagtgcggttagatcaatacaagttttttgatcaagggaatatggcatgatttttgtacaaattatcaaaagagagttaaaaattgcttgtcgaaagcaagctgagatcttaaatcctttatggttttttttgattattttaaccttgtttcctttggttattggtccggatcctaagctattagctaaaatagctcccggaatagcttgggttgccgctttgctatcggcattactttcatttgagcgtttatttcgtgatgattttgtggacggttctcttgagcaattgatgttgacagcgcaacctttagcgatgaccgccttggcaaaagtcattgcacattggcttttaaccggtttaccgttaattttactttcgcccattgccggactattactttcattagagttgcatatttggtgggcattagttttaacattgttgttaggaacgccaaccttgagttgtttgggagccattggtgtggcacttacggtagggttgcgtaaggggggcgttttgctgagtttattagtcttacctctatttataccggtattaattttttctgccgctgttttagatgctgcaacattaaatttatcttataacgggcaactcgcaattctgggagctatttttgtttcagtggcaacactttcacctttcgccatttcaattgcgttaagagtgagcttagaccagtaattaacttagtgaagatttgttttttaaataacatagtaaggacaacatgatgtggaaatggttacatccttatgcaaaatcggaaacacaatatcacttatgtggtaagtttgttcctttgtttgcaacagtatctatacttttattaataaccggcgtaatttgggggcttgcttttgcaccggctgattatcagcaaggtaacagtttccgtattatttatattcatgttcctgcggcaattttttctatgggaatttatgtgtctatggcaattgccggagtgattggtttagtttggcaaattcgccaagcgtatttgagtattctcgctatggcacccatcggtattgtgtttacttttttgacattggtcactggagcaatttggggtaaaccgacttggggaacttggtgggtgtgggatgctcgtttaacttcttccttgattttattctttttatatttaggcgttatcgcactttactctgcttttcaagatcgtttaatcggtatgaaagcagcagcaattctttctattgtgggggtagtcaatattccggttattcatttttctgttcagtggtggaataccttacatcaaggggcaagcattacaaaatttgaaaaaccttccattgcaacacctatgttaattccgcttattctctgtattttcggttttatggcattaacaatgtggtttactttaatgaattatcgaacccaactgttaaaagatgagagcaaacgcccttgggttaaagcattagtaaaataggagtttattatgttttttcaaagttggagtgattttttttatatgggcggttatgggctttatgtttggctatcttatgggatttctttccttgctattataggattaggcttgcaaaatatttatcttcgcaaagccctatttaaagaaattcaacgtgaacaattgcgttcagtgcgtcaaaaaaatacgcaagctgaaaacaatggagaaaacctatgaacccaagacgtaaatcaagattatcggtagtactgtttattttactgggcatatccgttgcctctgctttggtgttgtatgcgttgcgtcaaaatattgatttgttttatacgccaacagaagttgtgaatggaaaaaataacgaaagccataccaagcctagtattgggcaacgtattagaattggcggaatggttgtggaaggaacggtagaacgtgatcctaaaagtttaaaagtcagatttgacttaaatgatattggaccttcagtaacggttatttatgaaggtattttgcctgatttatttcgtgaaggacagggcattgttgctcaaggtgtacttattgagccaactgtactgaatgcaacggaagttttggcaaagcatgatgaaaattatgttccgccggaattagaagcacaaatgcagaaaattcataagcctatgggcatatcggatctcaagaatgaaagtgatcgtgatcgtcaagaaaaacaatttaaagaaggtaaccaatgatcgctgaattaggcaattatgctctggctttaagtttagctatttctgttttattatctatttttccattatggggagcggaaaaaggcaatgtacagatgatggctttagctcgcccaatgacctatggtttatttgttagcttaactgtttcttttgttgcacttttctatttatttctgacaaatgatttttcagtacaatatgtggtgaacaattcaaataccaacttacctttgcaatatcgtctatccgctgtttggggctcccacgaaggttctttattactttggatttggctattgactctttggagtgcggctgtggcttttttgagtaaacaattaccccaagaagctgtggctcgtatcttggcaattatgggtattattacgattggtttcttactatttgtgatgtttacttctaacccttttgaccgcactttccctgattttcctgttgagggaagagaattaaatccattattacaagatattggtctgatttttcatccgcctttactttacatgggctatgtgggtttttccgttgcttttgcttttgctattgcatcattgatgacgggaaaactggataccgcatgggcaagatggtctcgaccttggacaatggctgcttgggtatttctaacattggggattgtgctgggatcgtggtgggcatattacgaacttggctggggcggttggtggttctgggatcctgtagaaaacgcctctttaatgccttggcttgccggtattgcattgcttcattctcttgcggtaacggaaaaacgtggttcatttaaagcatggacagtattgctggcaattttggctttttcactgtgtttattaggtacttttttggttcgttccggtattttggtttcggtgcatgcttttgcctctgacccaactagaggtttatatattttagcttatttaattgtagttattggcggttcgctagcgttatacgcttataaaggcaatcttattcgcacaagaaacaatgctgaacgttattctcgagaaactatgttgttaatcaataatattttattaatgaccgcacttagtgtggtgttcttgggtactctcctgcctttagtacacaaacaattagggttgggaactatttctatcggctctccattttttgatcaaatgtttttattgatcatgattcctttatcacttttattgggtgtcggacctttagtaaagtggcgtcgagaccaattctgtgctattcgtcttccggttatcatcagttcaattattatgcttattaccggatttgttttaccttattttttacaagatcgtattgcagtgagtgccgttcttggtgtcatgatggcaatgtttattcttcttctagcactctatgaattgcagcaaagagcaacgcataagcatagcttttggattggcataacaaaattgtctcgttctcattggggaatggttttagcacatttaggggttgcgatgacgatatggggaattgcttttagccaaaattacagtattgaaagagacgttcgaatgaatgtgggggatacagtaaaaattgcagattatgaatttactttccaaggtatatccgatgtcaatggtgtcaattacttaggcggaaaggcacaaattgacatcagtcgaaacggtaagtttgaaaccacgttgtttgctgaaaaacgtttctatacagtgagtaaaatgacaatgactgaagcggctattgattgggggttatctcgagatctatatgttgcactgggcgaaagtttaaatgatggttcatgggctttacgcttgtattataaaccttttattcgttggatttggctgggaggtatatttatggcattcggcggattactctgtatatttgaccgacgttatcgttttggaaaacttctaaaacaaggataagttatgaataaaaaactttatataccattaattttattcctcggactagcctttgctttttttgtgcaactgcaacgtaatgcacaaagcgataatccaaaagcattggaaagtgccttaataggtaagtcggtgccaaataaactgctaactgatttactgacagataagcaatatgacaatcgtctattcaaacagggtaaacctttgctcgtcaacgtttgggcaacttggtgtccaacttgttatgcggaacatcaatttctcaatgaacttcataaacaaggtattaacattattggcattaattataaagataaaacggataaagccataaaatggatcaaaaagttaggcaacccttatcaagtaattgtaaaagatgaaaaaggatcttttgggctggatctcggtgtttatggtactccggaaacgtttatcgtggatggaaacgggattattcattaccgccataccggtgatataaatgaacgtatctggaaagaaaaaatacagccaatttatcaacaagtaagtgagaaaaaatgatgacaaaattacgttattttctgaccgcactttttctcagtttttcagcacaagctgcgattgatgcacttaattttacctctatgcaacaagaaaaagattatcacagcttgactcaagaactgcgttgtcctcaatgtcaaaataacaacattgctgattccaatgcttcgattgctgtagatatgcgggcaaaagtgtatgaacttttacaaaaaggtcaaaataagcaacaaattatcgattatatggttgaacgatatggaaattttgtgacttataatccgccggtaacaggttcaacaatcattttatgggttgctcctttggctttgatgattcttggtgttgttattgtgctacgccgtaaatccggttcatccagcaaaagtgcggtagaagctcagccaaatttaactcaagaacaacaaaagcgtttagaagaattattaaaagaacgggaataaaaaatgattttttgggtaatttgccttttattaacattagctattgcatttatttgtttttatcctctgcttagaaacaagacagaaaaatcaaccaatttaaaacgagatgaattaaataaggccttttatttcaataggttgaaagaaattgaggaagacgaacaatacggtttattagaaaatagtcaagagtttaaaacagaattacaacaaacgttgttggaagatattcctgaaaaaatggctgttgagaagagcaataagcaatacggacaaatttggtttatttccggttttttgactttagcgattattgctcctttaacttatatgagtgtaggttcttggcaatctgagataatgttagaaaaaacttacgaaaaattaccgcacttttatgcaagagtaaaagaggaagcaaacaaaccgctaaatgaaaatgagctacaacaatttgctgttgcactgcggttaaaattacaaaaagaacccaataatgcggctgattggtggacgctaggacaagtggcaatgaatctggaaaaagcacaacttgcttttgatagtttttctcaagccaataaattagcaccgcagaatattgaatataagctatcacttgctcgaattttgatgttttcacaagatcaaattgatcgtcaaagagggatgaatttattaaaagaagtgttgcgtattgatcatactaatatgcaagccttaagtttgcttgctttccagtattttgagtcggaagattatcaaagagccgctgtaacttggacaatgatgcttcggttcatgccgaaaaatgatccaagagttcctttaattgaaaaaagtattcgtacagcacgtgatgctatcaaagaagatagcaaataaaaccggttatatatgaaaaatttaaagtattttgcacaaaaatatgtggattgggttattcgcttgggaagaattagattttccctattaggtgtttgtattttggcagtagttgctttgcttacacaaatagtggtgagtttaatttttataggaactatctattggcaagatgtagctcgttctattatctttggtttgttttcagctccttttgttttatatttttttacgttattggtagagaaattggaaaaatcacgccttgatttagcgaagttagtggataatttacgcaatgaggtatcagagcgtattcttgctgaaagaaagttatcggttgcgttgagtgagattgaaaaaaccagtcaagataagaccgcacttatgacaacaatcagtcatgaattgcgtacccctttgaatggcattattggcttaagccagattttgcttgatgacaaattaacagagcaacaacgtaattatcttaaaacgattaacgtgagtgctatttctttgacgcatatttttagtgatattattgatctcgaaaaaattgatgccaatcgtatagaattacattatcaaccgactaatttgtgcagctttttaaatgatattaccaattttgctacattaatggcggcacagcgtaaattaaagtttgaattggcgtgcgataaagatttacctgattggctgatgttggatagtgcaagattaagccagatattatggaatttaattaataatgcagtgaaatttacacctgccggaaaaataaaactgaaggtttctcgcttgacggatgatactttttcttttgcgttatctgataccggtgttgggatagcaaaaggggagttggataaaatttttactatgtattatcaagtacaagaaaccgatcataaacctatcggtagtggtatcggtctggctgtgtctaaagcaatagcaggtttaatgggcggtgatttaaccgttgaaagccaattgcatcaaggggcaacctttacgctcactttacaggctaaagctgtagaaaaaccggcagaaagcgaatctaatgtgcctaatacattgacgatcctattagttgaagatattgaggtaaatattattgtagctaaatccgtattggagaaattaggttactgtgtggacgttgccatgaccggtaaagaggctattcaaaaatttgagcaaaattattatgatttggtgttgttggatattcaattgcctgatatgtcaggatttactattgcacaatatttacgtgaaaaatatgaacaaggtgtttatgattttctccctcctttaattgcattgaccgctaatattatgcaaagtaaaaccgaatatcaaaaacaaggcatggatgatgttttacgtaaacctttatctttagaggcgttagtaaattgtttatcggattatttcggtgatgagttaaatacaaagattattaaaaaatcctctttcgtagagttttctgctttatccgatgttcttaatatggaactgttggttgagctgaatgatattttaggtaaagaatttattggtaaaaacctattattatttaagcaaactatgccaagctatgtaaatgaattattagacagttatgaacaatataaacaggatagtgcagtaaaaaaagatttactttctaatgtacataaaatcaagggagcggcggcatccgtcgggttacttcgtttacagcaagttgcctctttggctcaagatgctaaccacgaaaattgggaaacgcatatcgatgagtggatcaataccttggcaaatgattggttggttgatacggcgacattagaggattggttgaatgatctgtaatttattaaggaataatagttgcaaaaaggggagtacaactttaaacttgagcctttgccattgatatagttaacactcgaataattatgacaaatttaactgaaaaactggaagaaactgccagcaataatgagcttttattaggtgagcgttttcgcatggctcgtgaaaaattacagttgtctttagatgatgtatctaaacaaattaatttaagacccgctattttacagcttcttgaaaataatgagtttacacataagagcattcctacaactttcatgaagggttatgtgcgtaattatgcgaagtttctacgcataccggaagaaatatggacaaaagcaatttcctccgtggaggaaaatacacgccataatttaggtaaaaatacttgcttgatgaaagcggtaaatgggcattcttctcatgggcgttggattggttatgtaacggtattggtgttgttgattgtatccggtatgacggcgttatggtggtggggaaattaccaaaaatcaaatcaagaacgtgacacttttgtacaacattatgtagaaaatgtaccatcggagcggattgaaattcaagcggatcaagtgcttgaaaaaaatttaacgatccctgtggaaaagccacaggttgtttctgttaatgaaactactgtcgtaaataaagacagtatggcagaaaataagttgacctcagtttctacgcaagagcaaagtgcggtacaaaatccacaagaaatagtgagcaacaaaacatcagaaactgaaaaaacggttaaaaatacagaaacctttgtcggcggtgatttgcaaatagaaattatcggggccagttgctggattagtgttaaagacgctaaacataaagtattagcacaaaaagaatataaacaaggcgaagttttggtctttactgatggatcaccttattctttaattatcggtgccccaagcaatgttaaaattacttacaaaggtgaacattatccattaaaagttgacggacgtgttgctaaattcaaattacagtaaattattatgtcatcgtttaaaccaactattaatcgtcgtcaatcgacaaaaatttatgtgggaaatgtaccgataggtggtgatgcacctattgccgtacaatctatgaccaatacaagaacgactgacatagaagcaacagtggcacaaattaaagcattggagcgtgtcggtgctgatattgtgcgtatttctgtgcctactatggatgcggcagaggcgttcaaatcaattaaacagcaggttaatattccgttagttgcagacatccactttgattatcgtattgctcttaaggtggcggaatatggggtagattgtttgcgaattaatcccggtaatattgggcgtgaagatcgtatccgtgccgttgttgattgtgcgaaggacaaaaatatccctattcgtataggtgttaatgcaggatctttagaaaaagatctacaggaaaaatatggcgaacctacaccggaggctttgctggaaagtgcgttacgtcatgtggaaattttagatcgtttgaacttcgatcagtttaaggttagtgtgaaagcctcggatgtctttcttgcggtagaaagctatcgcttattggcaaaagcaattaaacaaccactgcatttaggaattaccgaagccggtggagcacgtgccggtgcggtaaaaagtgcggtcggtttggggatgcttttagcggaaggcattggcgatacattacgcgtttctttagcagccgatcctgtcgaagaaatcaaagtcggttttgatattttaaaatctctacgtattcgttctcacggcattaattttattgcctgtccgacttgctctcgtcaggagtttgatgtgattggcaccgtcaatgcacttgagcaacgtttggaagatattgttacaccaatggatgtatccattatcggttgtgtggtgaacggaccaggcgaagcgttaatttcagatcttggagtaacaggcggtaataaaaagagcggttattatttagatggaaaacgtcaaaaagaacgctttgataatgaggatttaattaatcagttagaggcaaaaattcgtgcgaaagtcgcacagcaagatccaaaaaacagaattatctaaaggaagaatattgtggcaaaaacaattcaagcaattcgaggtatgaacgattgttcacctactgaaagtctcttgtggcagtgggtagaagaaaaagtgcggtcggttttacaaacttatggttattctgaagttcgaatgcctatcgtagaaagtacccctttatttgctcgtgctattggtgaagtaacagatgttgtatcaaaggaaatgtacacattttgggataacgatgaacaattaactttacgaccagaaggtactgccggatgcgtgcgtgcggcaattgagcatggctggatttacaataatgaacaacgtctttggtatatgggacctatgtttcgtcatgagcgtccgcaaaaaggacgttatcgtcaattccatcaagccggtgtagaagtgtttggtatagcgaatccagaaattgatgctgaattgattttattaactgctcgtttatggaaacaactgggtatttttgatcatgtaacgttacaacttaattctattggttctcttgagtctcgacaaaattaccgttctgcattagtggaatttttacagcaacatacggatctattaagtgaggaagaaaaagaacgtttagtgaaaaatccactacgtattttagatacgaagaatcaggtgctacaagaagtattaaatgatgcaccgaaattattggattatttagatcaagagagtcgagaacattttagtcaactatgcgatttattagatgccgtcggtattcaatatgaaatcaatcctaaattggttcgaggtttagattactacaataaaacggtgtttgaatgggtaacttccgctttgggggcacagggtacagtttgtggcggcggtcgttatgacggtttagtcgaacaacttggcggtcatgcaacttgtagtgtgggttttgctatgggattggaacgcttggttttactggtgcaagaagtgaataagcaaatcgttttaccaagtgcggtagatatttatgtggtttattttggtgaaaaaacgactttacctgcattccagttagctgaaaaaattcgtacggaattaccgcatttacgcacaatgacacattgtggtggcggtaactttaagaaacaatttaaacgtgcggataaagttggtgcaaaatttgctctagtgattggcgaaaccgaggtgaaaacacagcaggttgtcgtaaaagatttactgggtggtgccgagcaattgagcttggcattaacagatgtagttatttacttaaaacaagcaattactcaataaggatactaaaatggcttatacaatcgaagaagaacaagaactgaatgaattaaagacttggtggaaagaaaattacaaatctattattgtaattgtggttcttgccttttcaggcgtatttggttggcgttattggcaagattaccaaacaacgaaaaaacaaacactttctgcacaatatgatcaactgatcagcagtgccgaaaatcaaagcatctacaatgctcagctggatcggtttgtgcaagaaaatggagaaacaacttatgctgtgtttgccttgttagataaagctaaacttgaagtcagtcaacaaaattttgtgcaagcagaggaaacattaaagcaggctattgtgaatacgagtgatgatattttaatgtcaattaccgcaattcggctagccacagttcaatatcagttacaaaagtttgatgaggctttagcaagtcttaatcaagttaaaggtcaatcttgggatgttagcaagttgttattgtccggtgatatacagttggcaaaaggcaataaagagatagcaaaggacaattttgaacaagcactaacaaaagccacatcttgggaaaaatcattcatccaagtcagattaaatagtctgtaattgtctaattattgaagccttgatacctcaaggcttttttataggaagttatttatcatgaatattcaacacttattgaaaacacaagcctatattaatggagaatttatttctgccaaaaatcaccgcacttttcccgtgataaaccctgctaatcaacaggttatttgtgaaattgcctgttgtggtaaagaggaaacagaattagcgattaaaagtgctaaacaagcacaagtacattggaaaaaatataccgcaaaagagcggtcaaaaattttaaagaaatggtttgaattgattatgcaacatcaagaaagtcttgcatatttactaagtttagaacaaggaaaaccgcttagtgaaagtcgagctgaaattgcttatggtgcaagtttcgtcgaatggtttgctgaggaagctaaacgtgcttatggtgagattatcccacaggtgagagaagatcatcgattgcttgtgattaaacagccggtaggggtagttgctgcaataacaccttggaattttccaaatgcaatgatcacacgaaaagccgctccggcactggctgcagggtgtgccattattattaaacctgcaccggaaacgcctttatccgctttagcattggcagcattagccgagcaagcgggtataccgaaaggtatatttaacgttttaccgacagtatatgcagaagaagtcggaagtgttttaactcgaagtactgatgtacgtaaattaacgtttaccggttcgactaaaattggcaaaattttaatgcagcaatgtgctgatacggtgaaaaaaataagtcttgaattagggggaaatgcaccatctttgatttttaatgacgcagatttagatagaaccgtcgattctgttatagcctcaaaattccgcaactcagggcaaacctgtatttgtactaatcgaatttatgtgcagtcggagatttatcgtgcgtttgctgataaattaaaacaaaaagtgcgatcatttatcgtaggagattttcagcaagaagcggtaaatattggaccgttaattaatgaaagtgcggtacgaaaaattgaacgacacattgaggatgcgttaagcaaaggtgcaattttaactttaggtgggcaacgccattctctagggggaactttttttgaaccaactattttagaaaatgtgtcgcaagatatgttagtttgccatgaagaaactttttcccctctagcagcgttgattcctttcgatacggaagaacaagcaattagcatggcaaatgatagcgagttcggtttagctgcgtatgtgtatacacaagatttcagtcgtatttggcgactttcggaagaattggaatgtggattagttggagttaatgaaggcattatttccaatgaagtctctccgtttggtggagttaagcaatcgggcttgggtagagaaggctctcgtcacggactggatgagtttttagaaatgaagtatttgtgtatgaaagtttagtttgcaatgcaacaagtcaattgattatccctgctgaggtggaaagtacgacaacacgtgtattaggatcggcaattacaagttttgaaactgcgagattagacatcagtaaattccttttagttaaggaaaggggctattgccccttatgataattattgacgcacagtatagtcgcctgaacaaacccatttgtaggtggtaagtgcttccaatcccattgggcctcgagcgtgtaatttttgtgtactaaccgccacttctgcccctaaaccgaattgtccaccatcagtaaatcttgtgcttgcattaacataaactgcggcagcatccacaagggaaacaaattggtgagcaagtcttggtgatgacgttaaaattgcttctgaatgttgtgtgccgtattcggtaatatgtgcaatggcttgttgaatatctttgacaacaacaacatttaaatccaatgaaccccattcttgacgtagctgttgttcttgtacaatagatacttctgcattttgtttttccaatattgaaagtgcggtcggatctgcgtgatattttacatttttgtgtttcaaatgagcgacaagcttaggtaaaaattctgtggcgatactttcttgcactagcagagtttctaaggtgttgcatgtactcggacgttgagttttagcattgtcgattacagccaaggctttatcttgctccgcactttcctccacaaatacatggcaaaccccaacaccgccaataatgaccgggattgtagagttttgtttgcaaaactcatgtaaacccgcaccgccacgaggaataatcatatccacatatttatccaatttaagtaattctaatacgaagtttcgatccggatcggtaatagcttgtaccgcatttttaggtaatccggtttgctccaacgcatcttgaattacttttaccaaaattttattggaataattggtttcttttccgcctcgtaagataacggcattacttgtttttaaacaaagtgttgcaacatcgacggttacatttggacgagcttcataaattacaccaataacacctaaaggcacacgaactcgttctaattttgtaccactttctaaaataccgccatcaatgatttgtccgataggatccgacaatgaaataatatgacgaacatcttttgcgatactatttatgcgttccttggtgagtaagaggcgatcgataattgcatcagataatccattttcttttgccagctgaatatccttagcattttctacaagaattttatcgctttgtaattccaattgttcagcgataatttgtaaggcggtatttttttgttgttgagaaagttgagccaaaatcgtagcggcttgtttagcattttttcccatttcttttaaactcatacaatatccttattttgtttttttaggtaatttatcatgcgttttgactttttctgcttcttgctcttgataatcaaaaataggcaatccccattcgaaataaatggcgagcaaacgaatagtgaagccactaattaacgtaataataatgaccaaattttgattaatctgtaattgttgtaagccaacataaataccggtagctaataatgcaacactggcataaagctctttttggaacactaaaggaatgcggttacagagcgaatctcgtaatacaccaccaaaggctcccgtaacgatagcggctatacaggtaacagtaaaaccatgccccatgtccaaagcaatttgagcaccaataatggaaaatacgatcaatcctagtgcatctaagaccaaaaaaatggtacggaagtagcgtataaagtgtttgataaaaggagctataaaaacagtgagtatagccgctccggtaacaatcaagaaataatgtgggtttttaacccaacccaagggataatgcccgagcaagatatcccgaatcgatcctccaccgatggctgtcattgaagcaataataataaccccaaaaatatccattttttctcgtccggcagccaatgctccggttatcgcttctgctgtaatgccgataatatagagaatactcagtaacataagtgtccttaaagtgcggtaaaaggattactattttagagtgcatagaacaaagaaacaatgttatttttgagctaacccaagaagttaggcggatttactgcaaggaaaatttaaccggataaaaaagaaattctcatatcatcaaatttagcaaggattattcattagaagaataaagtatttctttataatgtttacggcataccgacatataactatcatttccgccaatttgaatttgctcaccgtctttgactgctttaccttgttcatttaagcgtaaaacaaaattagctttacgaccgcagtaacaaatagttttcaattcttcaagttgatctgcccaagccaacagatatttgcttccttcgaataattctgcttggaaatctgtacgcagaccatagcataataccggaatattgagttcatctaccacattgcttagttgatagacttgtgctttcgttaaaaactgagcttcatcaattaaaatacaatgtaatttttgttgcttaatatgcagtgctatttcagtaaaaagatcagtgtctttatgaaataaattcgcttgtctatgaatgccaatacgtgaactcactttacctttaccaaaacgatcgtcgatggcagctgtataaactaacgtattcatgttacgttcacgatagttataatccgattgtaataaggttgtagatttccccgcattcatcgtggaataataaaaatatagttttgccattatgttaatacccaaccgccggaaataatatatattaagtttgatttttccattatttatcttaaattgctttcagttcagtcattgcccagcggggtttaacgtcaatttccaaaggtgaatattcaccttgttttagacgcaaaaaaccgacgtaagcaatcattgcaccgttatctgtacaaaattgaggttgagggtaaaagacctctccttttaattgtttcatcatatccgctaaagattgacgtaattgtttatttgcactcacaccgcctgcaatgactaagcgtttaaagcctgtttcttttaaagctcgacgacatttaattgctaacgtatctactactgcttgttggaatgcgtaggcgatatctgctttagtttgttcagtgagttcaccttcttgtttaattgcttgattaattgtattggcggcaaaagtttttaaacctgaaaaactaaaatctaagccggggcgatctgtcataggacgaggaaagaaaaaacgttcgggattcccttgttctgccaaacgtgaaagtgcactccctccagggtaatccaatcctaataattttgccgttttatcaaatgcttcaccggcagcatcgtcaatactttctcccagtaattcatattgccctacagcattaacacgaacaagctgtgtatgtccgccggatactaataacgctacaaaaggaaattttgggggattattttctaacataggggcaagtaaatgcccttccatatgatgtacaccaatagctttaatgttccaagcataggcaagcgagcgtgcaattgttgaacctactaaaagtgcacccaccaatcccggtccacaagtgtaagctatgccatcaatgtcttttgcttctaatcccgcttgttgtaaagccgcctgaattaatggtgcggttttacggatatgatcacgagacgctaattcagggacaacaccgccataatcagcatgtaaagcaatttgagtatacagttgattggcaatcaatccttttttttcatcgtaaatggcaacgcctgtttcatcacaagatgtttctatgcctagaatacgcattttgtttctcttctttattgaatttcgaaatagagtagattctaccttttttacttaaattaaactagcgtattgatttttttaagagaaaaagtgcggtatttaaaagtgcggtattttttagaatttttttattttttcgacatatctcgcaaaattagcttgcttattttctaaatgaatttttttgtattaacctcttaccagttatgagtacggaacaataggaaaaatatggataaacggaatgagttgttactgcgtttgttacaagtgccgaagttgggagcgtccggaataactcaacttttatcacacatcgatttaaaaacattagaggattatgatgatgttgcgtttcattatttaggctggaaacctgaacaggtaaatagatggttgtatccggatcttagatatattgaacctgcattattttgggcaagcaaaaagggacattatttgatgaatttctatcaagagaattacccttatttattaaagcaaaccataggtgctccccctttgttatttatcaaaggcaatccggaaatacttgctcaacaacaagtcgctattgtaggaagccgtcattgctcacattatggcgagtattgggcaaagtattttgcaacggaattgttccttgccggttttgttattaccagtggactggctttagggatagacggtttttgtcatcaggctgttgtggatattcaaggacaaactatcggggtattagggggaggtttggaagagttgtatcccaaacaacataaaaaattagcacaacaaatgctagattatggcggtgcgttagtgtcagaatttttacctcatcagcctcccaaaccacaacattttcctcaacgtaatcgcattattagcggactttctaaaggtgttttagtggttgaggcaacagaaaaaagcggttcactcattactgcacgttatgctttagaacaaaatagagaagtttttgcacttccggggcaaattcaaaatgagtatagtcaagggtgtcatagattaataaaagacggtgcattgttagtagagaatgttgcagatattgtagaaaatttatcgccttttatgcattatgaacgtcaactaacagcaaaacagatagaaacgcaatttccgccggcttataagttacctgcttcaccgacttatcctgaactctatgcccatattggatatacgccggtagggcttgatgaattatcaaataaaagcggattaagtgtagataccttattgatacagctgttagaacttgaattgcaagatctcgttattgctgaaaaagggttatatcgacggacttaaatgttgatataagcgataactgacttgttttgtgtttttttcttttaataattgccaatttgcaggcgttgttaagcttttttctcgttctgtttccacataaataagtgcattggcatgtaaccaattatgctgtactagtaacttaatggcttgttcagcaagattaaagtagaaaggaggatcaataaaaacaatatcaaagtgcggttcggtttgagttttgtttaaatagtgcaaactattttgattaataacgtttgcattggtacattttaatatagcgacatttttattgagctgattagctattgttttgtctaattcaaggaatgtaacatttttggcttggcgtgaaagtgcttcaaagccgagagaaccgcttccggcaaagcagtctaaacaattggaatcaacgatatgaggcattagccaattgaataaggtttccttaacacgatctcctgttggtcttaaacctgtagaattcaaaacaggtaattttctggcacgccaaagtccggcaataattctgacttcccctttgtttttctcttgtatacggtttggttgattttttttcattaaaaattaattatgataaactaaatgcagtttcgtaattttaacagaaaagtgagcaattttatgtcagaagaaaagaaaaaaggtagattttggtcttggttaggattggggcagaaaacagaagatccgatatcagaacagcaaccggagcaacaatcaggacaacaggaaagtgttgcaagggagcaagaatctacttcgaatatagagcaggttataaaagaaccagagcatattgatgacacttcatcagacttggttttatccgctcatttacaggagcaagaggtaaaagaatactcacttcatgaacgggaactgtctcaaaatactgtaatagaaacagaaagtgcggttgaaaaaacagatatttttattgaagaggatacaacatatcaggctatcaataaggagcagcgagaggaaacaacgattacatcggttaaagaagtaataccgcaagaacaagaaaaaccggctgaaaatggttttttcagtcgtttagtcaaaggattattaaaaaccaagcaaaatatcggtatcggtttccgcagtttgtttttgggcaagaaaattgatgacgagttatttgaggagttagaagaacaactattgatcgctgatatcggtgtgccaactacgacaaaaatcatcaataatttaattcagcatgcaagccgtaaacaattgcaagaggcagatttactttatcaacaacttaaagtggaattagccgatattttaaaaccggtcgagcaacctttacaacttgataacagtaaaaaaccttatgttatcttgatggttggtgtaaatggtgtgggtaaaaccactacaatcggcaaattggctaatcaattccaaaggcaaggcaaatccgttatgttggcggcaggagatacgttccgtgctgcggctgttgagcagcttcaagtttggggagaacgtaaccagattcctgttattgcacaaagtacaggttcagattctgcttctgtcatttttgatgctatgcaatcggcagtggcacgtaatattgatgtgcttattgcggatacggctgggcgtttgcagaataaaaataacctgatggatgagttgaaaaaaattgttcgtgtgataaaaaaatgtgatgaaacagcaccgcatgaaatcatgctaactcttgatagtggaacgggacaaaatgcaattagtcaagcgaaattgttcaatgaagcggtaggattaacgggtattagtctaaccaagttggatggaacagcaaaaggcggtgttatttttgcgattgcagatcaatttaatttacctattcgctatattggtgtcggtgagaaaatcgatgatttacgcccattccaagcagatgaatttattgacgcactttttgtacaagaagagtaaatgttgaaatacaaatcttagaatgatcatcttagatggcaagttattatttagcataaaacgtaggaaattctatactatcgttgactatgcctctaatgataggaagtgcggtattttttatatgaattcaatctagttttaaatcattttacttaacattacctagaaataagatgatgttttcggatgcccaacaatattaacatcacaaaataagttatcacagcgacgaaaatcagccagcccagccaatgtacacgagtgaaaaaggtcatttgtttccaaagactgagtgctggtgaataataccaaataaccgcccccatagtgatcgcagagattaaaactttgacaaaaaagaccgcactttgtcgagtaaaatggtaaatatccgctttagctaatcctcgataaagcaagtaagcattcagtgttgctgacattgctgaagcgatagccaatccaatataactgaacgggatagcgagtaaattaaatcccatattacttaccatagcaataattccaatttttaccggagtttgggtatcttgccgagcataatagccattggctaaaattttaatcagcataaaactcaacaatccggcgttaaatgcccaaagggaataagaggcggcttgcacatcagaaaatgaaaatttcccacgcatgaacagtaccaataacatcggttgtgccaaaacagcaatgccaatcattgccggaatgccaaataataagatcattctgacgccccaatccattgtttgacgaaaatcaaccgcacttttttcaatgttatctgtacgattaacataatgtcgagatagagttggaagaataacggttgaaatcgcaataccaaataaaccgagaggaaattctaataaacgatctgagtaataaagccagctgattgatccagtcattaaaaaactggcaataaaagtatccaatagaagatttatttgatttacagaaacaccgaatagtgccggaatcatcaaggttcttattttttttacgccctcatcatgccaagcccattgaggttttgttaaaaatccggcttgttttaaaaaaggaatttgaaagagaaattgtagcaagccaccaataaagatcccgatagcaagagcaagatcaggactttctaatcgaggagcgagaaaaagagcggtgcaaatcatagctatattgagaagaacgggcgaaaaagacatcacgccaaatttaccgatggtatttaaaattgcaccagataacgccacaaaagtgataaaccataaataagggaaagtaattttgaggagtaaagaggcttgttcaaattttattgcattggggctgtcatttagccaatcaataaaccaacctgtgccaaagatcgccgtaattacaggagaaaaaagcattgctaataaggtcactactgaaaccaatccgcccaaagtacctgatactttacctataaattctctggttttacttaaatcgcctgatttttggtattctgctaaaactggtacaaaggcttgtgaaaaagcaccttcggcaaataaacgtcttaaaaaatttggaatgcgattagcaaataaaaaaacatccgccactacacctgcacctaatatttgtgcagtaataacatcacgaattaaacctaagatacgtgataacaaagtcattgcactgacgataatgcctgatttcaataattttttgctcaaaataagtttcctttcatgaaaaattggcttaattgtatataaattttatttttaagctatattccaaacgaaaaaactgttagaattccgcctacatcgtaactaggctcaacaactaaaggcaattgaggaaagctaacgatggttgtttcggttgtgtctcaccgaaatccttaacccaaattttgctaattgtttattgacaattgtatagaaaaaaggcatattttacgcctttattttttcgtaaactaacagatattttaggagtttgaccttggctaatatcaagtcagctaaaaaacgtgcggttcaatctgaaaaacgccgtcaacataacgcaagccaacgctctatgatgcgtacttttatcaaaaaaacctatgcagcagtagcaacaggtgataaagcagtagctcaagctgcttttgttgaaatgcaaaaagttgtagaccgcatggcatctaaaggcttaattcacgctaacaaagcagctaaccacaaatctaagttagcggcacaaatcaaaaaattagcgtaattttttaaaaccgataaaaacaaaaccgcactttaaagtgcggttttttatcagctgttgattaacgggtactggtactcgttgtcgtacggtttgcacgtttacgctctacctcagttaaaagttttttacgaatacgtacagaaattggcgttacttcaactaactcatcatcatcaataaactctaatgcttgttcaagtgtgagtttcaatggtgtggttaaagtcaacgcatcatctttacctgaagcacgcatattggtgagttttttaccctccagcgggttgacagttaaatcattagaacgactatgaataccaattatttgtccttcataaatttctgcaccatgatcaaccattagcttgccacgatcttgtagggcataaagtgaataagccaaggctttacctgtaccgtttgaaatcagtacgccgttaatacgctggccaatttcacccggttttacatcatcataatggctgaaactagagtaaagtaagcctgtccctgaagtcattgtcataaattcattacggaaaccaatgagcccacgacttggaataatgtattctaagcgagtacgacctttaccgtccggtatcatatcacgtacttcacctttgcgaataccgagtgcttccatgacagaaccttgatgttgttcttcaatatcaatagtcacttgctcgaaaggctcttgcttgcgaccatcaatttctttaaaaattactttaggacgagaaaccgccagctcatagccttcacgacgcatattttcaattaatacggataagtgcaattccccacggccggatacactgaaaatatccgaatcatccgtttcttctacacgcaatgccacattatgtacaagctcttttttcaaacgctctaaaatttggcgggaagtgacaaatttaccttcttttccacagaatggtgaagtatttacacaaaagaacatagttactgtcggttcatcaacgcttaatgcaggcaatgcttccacattgttaatatcacaaacagtatctgaaatatttaactcacctaaaccggtaatggctataatatcacctgcataagcttcttgagcttcgtaacgctgtaaacctaagtgtcctaaaacctgaccgatacgaccattgcgggttttcccttcaggatcaattaatgtaacaggttgatttggttttactgtaccacgtttaatacgtccaatcccaatgacacctaaatatttgctgtaatctaattgggagatttgcatttggaacggtgcatccaactcaacatccggcggcgaaacatgttcaataattgcttcaaagagcggatccatattagaagccaatttttcatgttcaagaccggctacaccgtttaacgcagaagcataaataataggaaaatcaagttgttcatctgtggcacccaaatttacaaagagatcaaatacttgatctactacccagtcaggacgtgctccgggacgatccactttattgatgacaacaatcggttttaaaccatgtgagaaggctttttgggtgacgaagcgggtttgtggcattggaccgtcaaaggcatcgacaaccaacaatacggaatctaccattgaaagtactcgctctacttctccaccaaagtctgcgtgtcctggtgtatccacgatattaatacgatagccgttccaattaattgcggtatttttcgcaagaatagtaattccacgttctttttccaagtcattggaatccattacacgttcatcagtatcaccacgagaagtgtctaatgtgcctgaaagtttaagaagcttgtcaacgagggttgttttaccatggtcaacgtgtgcaataattgcaatattgcgtaatttttgaatatcaattttatctgtcatttgaataatctagagttataaaaaattaaaaatttcttccgcactttacgtttcaaaatagttcatttttacatctataccgtgcggaaaggtcgccgattatacaactttttgttattaggagctataaaaaaacgacctccgaccttcaccgatataaaattccctatcctattcccctctaattgattataatctccgttcaaatttatttccgttcccactaaagtagagagagtattatgtcaaacacaacagctattacgaatgtattcaagttaatcgaagaaaatgatattaagtttgttcttcttcgttttaccgacgttaagggtaaagaacatggcgtttccctgccggtcagtttagttgatgaggacttgtttgaagacggtaaaatgtttgatggctcctcagttgaaggttggaaagccataaataaggcagatatgttattgatgccaattgctgaaaccgccgttgttgatccttttgctcaaattccgacactttcaatccgttgcagtatttttgaaccgactactatgcaaagttatgacagagatccacgctcaattgccatgcgtgcagaaaattatatgcgttcaacaggcgttgcggatgatgtattttttggtcctgaaccagagtttttcttatttgatgatgtgcgttttgatgtctcgatgaacggtaactcttatactgtcgacgatattgaggcagcatggaatacaaataaacactatgaaggtggaaataaagcctatcgtcctttgaagaaagggggatattgtgcagttgcaccgaatgatatcgcacatgatattcgctcggaaatgtgtttgttaatggaagaaatgggattagtgattgaagcccatcaccacgaagttgcaacagcggggcaaaatgaaattgccactaaatttaatacacttacgttaaaagcagacgaaacgcaaatttataaatatattgtgcaaaatgttgcgtatgaacatggcaagacagcttgctttatgccaaagccaattataaacgacaacggttcaggtatgcattgcaacatgtctttgagtaaggacgggaaaaatattttccaaggtgataaatatgcagggctttctgagaccgcactttatttcattggggggattattaagcatgcaaaagccttaaatgcgtttaccaacccatcaaccaactcttataaacgcttagttccgggatttgaagcacctgttttattggcttattcagcaagtaaccgctctgcatcaattcgtattccggcggttactaatcctaaggctattcgtattgaagcacgtttccccgatccgttggctaacccatacttagcgttttcagcattattaatggctggtttagacggtattcaaaacaaactttatcccggtgatgcaatggacaaaaacctctatgatttaccgccggaagaactgaaagacattcctgccgttgcaagttcattaagtgaagcgttagataatttagaaaaagattatgaattcttaacgcatggtaaagtattcagcaaagaatttattgatacgtttattgcaatgaaacgtaaagaagtggaacgtttaaatatgacaccacatccagtagaatttgaaatgtactacgcttaatactggttagataaacaaaaagcgactaaatttgtttgagctgacctcacaggctagacagatttaatgcaaggactgtgttatatcatttacaggtcgcagtccttttagtttcacgtgaatatattcaaattgttgtaataaagtatctgaaattttcccgactttactctgataagaggatactttcttcgctggcaattcttaattttataccgcactttttactctttttttctcagcgaaacttctcctccgttaaattttctcaatactccattattcaacgctactaatagataaccctcttcatcaataccttgctcaattccacaaacgatttctttttcgctaataatatttacttcttgtccaaaaaaataatccaacttaatccaacgctgaaaaaaagcatgcattccctgttgctcaaaaatagtcaaatattgataccatttttttactaattgaattgcaagatcattacgatctatttccggcaaagtttccaataattccgcccaaggttgatcaattttgttttcttgcggtaaagataaatttatcccaatgccaacgataaaattaagtaatccatttttagcattgacgatttcaactaaaattcctgctaatttccgtccgaacaatagcagatcattcggccattttaacttaacctccgcacccatttcatttagcacttcagcagttgccagtcctaatactgaacttaaaccgtttaacgaaactgtcggattgaatgtccaataaaaactcaccattagttgaccggcaaaaggcgattgccattcccgtcctcgtctacctcgccctgcaaattgatactcggtaaaacacaagtctcctttgttcaactgtaaaatgttttccatgagatactgattagttgaattgataatagggtgataataaatcttataaggacttaattctgtttccaaataagatagatttaataaaggaagttgcggttttaaagaaatattttgctcattatcaacaatacaaattccttgttgtcttaattgtgctatctgcttttccagttgtactcttgtcaggtctaaaagtgcggtcaaattttcataagaataaggtttgcatctagctagaatagacaataatttaaacattttttcctcgctatcaccattataaaatctcwatyagcagtacttttaacacaatctttttcaagagraantattataaaaaagcattttcaaacaagtatgagatctgtataatcccgacgcaatattttttatcctttttaatcttaatagagagaatattgcactatgttacgcatcaaacaagaagctttaacttttgacgacgttctattagttccggctcattctacagtacttccaaatactgccaacctttcaactaaccttaccaaagaaatccgtctaaatattcccatgttatccgccgcaatggataccgttaccgaggctaaattggctatttctttagctcaagagggcggtatcggatttattcataaaaatatgaccattgaacgtcaagcggatcgtgtgcgtaaagtaaaaaaattcgaaagtggaattgtatctgaaccggttaccgtttcgccaacaatgacgttaactgaattagcggaattggctaagaaaaacgggtttgcaggttatcctgtagttgatgaacaaaaagggttggtagggatcattacagggcgtgatacacgtttcgtttcagacttgaataaaactgttgcggattttatgaccccaaaagatcgtttagttactgtgaaagaaggggctactcgagaagaaattttccatttaatgcacgaacatcgtgttgaaaaagtgctggtagtggataacagctttaaactaaaaggcatgatcaccttaaaagactaccaaaaagccgaaagtaagccgaatgcgtgtaaagatgaatttggtcgtttacgtgtcggtgccgcagtcggtgccggtcccggtaatgaagaacggattgatgcgttagtgaaagcaggagtagatgttttgttaatcgactcatctcacggacattccgaaggcgtgttgcaacgggtacgtgaaactcgtgctaaatatccaaatttacctattattgcagggaatattgcaacagcggaaggtgcgattgcattagctgatgcaggggcaagtgcggttaaagttgggattggaccgggatcaatttgtacgactcgtattgtaacaggtgtgggagtgccacaaattacggcgattgctgatgctgctgaagcattgcgtgagcgtggtattccagtgattgccgatggtggtatccgctattcgggtgacatcgctaaagcgattgcagcaggtgcatcttgtgttatggtcggatcaatgtttgcaggaacggaagaagcaccgggtgaaatcgaactttatcaagggcgagcatttaaatcttaccgaggtatgggttcccttggtgcaatgtcaaaaggatcttccgatcgttattttcaatccgataatgctgcggataagctagtgcctgaagggattgaagggcgtattccatacaaaggcttattaaaagaaattatccaccaacaaatgggtggattacgttcttgcatgggcttaaccggctgtgcgactatcgaagaattacgcactaaagcccaatttgtacgtatcagcggagcaggcatcaaagagagtcacgttcacgatgtgaccattaccaaagaagcaccgaattatcgaatgggctgatataacaaacggttggtttttgcaaaatttgcagaatttgtgtcgcttgtactgagataaggagcataaaatgaaaaaattaggtttgatttctatactgttattgtccggctgtggcatttttggtccatcatattcagggcaaacaacagcagactggttattaaaatcagatacagaaagcactattaggctatattttcgtgctataaataattgtggaatagaaaaaatccatacggaaatcaattcaataccgagtgcaggtaatgtaaatgaaacttggactgtaacaggctgtaatataacaaacgtttttaatgtgaaatatgttagtgacggtcatggcgggacttactttcgcgtatctaaaaaataaactaaaactttaggaaacaaaatgacaaatatccatcaccataaaatcctcattttagatttcggttcacaatatacgcaacttatcgcacgtcgtgtacgtgaaatcggggtgtattgcgagctttgggcttgggacgttacggaagaacaaattcgtgagtttaacccaacaggaattattctttcaggcggaccggaaagtacgactgaagcgaatagtccacgtgcaactgaatacgttttcaatgcaggtgtacctgttttaggtatttgctacggcatgcaaaccatggcaatgcagttgggcggtttaacagaaacttctacgcatcgtgagtttggctatgctgaagtttctctacaaaatccgaccgcactttttgcagatttaaacgatgatctgaccgcttgcgatccaaaattggacgtttggatgagccacggcgataaagtgactcgcctacctgataatttccaaattacaggcatgacctcgacttgcccgatcgcggctatgtcagatgaaagccgtcgtttctatggcgtgcaattccaccccgaagttacccacacaaagtgcggtcaaaaattactgcaaaattttgtggtagatatttgcggttgcgaaaccaattggaccgcagaaaatatcatcgaagatgcagtggctcgcattaaagcacaagtgggcgatgatgaagtaattttaggcttgtcaggtggcgtggattcatctgttaccgcacttttattgcatcgtgccatcggtaaaaatttacattgtgtctttgtcgataacggcttactccgtctaaatgaaggcgatcaggtcatggaaatgttcggtgataaattcggcttgaatattattcgagtagaagcagaagatcgctttttagaagcattaaaaggaattgatgaaccggaagcaaaacgcaaaactatcggtaaagtattcgttgatgtattcgatgatgaagcaaaaaaattaactgacgtaaaatggttagctcaaggaacgatttaccctgatgttatcgaatcggcagcaagcaaaaccggaaaagcccacgttatcaaatctcaccacaatgtaggaggcttacccgattatatgaaattaggtttagttgagccattacgtgaactcttcaaagatgaagtgcgtaaaatcggcttggcacttggcttgcctgcagaaatgcttaatcgccacccattcccaggccctggattaggtgtacgtgtactgggtgaaatcaaaaaagaatattgcgatttactgcgtaaagccgatgcaatttttatcgaagaactgcataaagcagattggtactacaaagtcagccaagcgttcagtgtcttcttgccggtaaaatctgttggggtaatgggcgacggtcgtaaatatgattgggttattagcctaagagcggtcgaaaccattgactttatgaccgcacattgggcaaacctaccttatgatttattaggcaaaatctcaaatcgcattatcaacgaagtcaacggcatctcccgtgtagtttatgacatctcaggaaaaccaccagcaacgattgagtgggagtagctaaaaatctaaagccttataaatagacattttgtgagtgttgtgcttgcaataaatcacctgaaggataattcttcgggtgattatactattaattcagggactgtattagattagccctaaatgacacacattttcgtagtgtttttaactgctctttagatattccaaagacttacattccttcaaaaataaaggagagtttattcggtcaattccattgtattttcagagtattcgtttggcttagcccccaaattttctatgtcgttgatgtagtcttgtttgactgcccccgaaatgattaattctttcgtggtgaaattcacttacatcaagggctaaatgataacggattagctcatggatgtttcgataaaacaatgcacttgaattttgatttatacctaaaatatctgctgcggatcgtgctgttacttctagcacaaaaaattcaaggagctttttctgtatagatttctttaatttacaatgagttgtcttcatttttatagactagcatacttgctaatctaatgttgcccctttttttatattgatgagtttgatagatagacactatcctaaaaaatcacaaaggcagcttaattctacaggtgataagattggaaatcggaagcttggtagagaagcaatttaaaagatatatcaatatcataattgcccgaattttcgctaaaaacgtaatatcgggcaaattatatggcattgtaaagagaataaatgtgaagcagttcacattctatacacaaattattgctgtatgatgaaataatttgttttattttatatgagaattgaaaatatatttcaaacttgtttcgtaatatataaagaggagtttgttatatgaatagtaaatttaccccccccctctccatttccacgcctgttgggaatctattaaacagcatcaagttcctgaatggtatgaagatgctaaattcgggatttttattcactggggaatttattccgtccccgcgtttgcaccaccgacttgtcaattaggtgagatcgatattgacgagcaatggttctgtaacaatccatatgccgagtggtatttcaattcaattaacgtcaaaaaaggtccgacttacgagcatcatatcaaaacctatggtgaagatttcagctatgaacagtttattccacaatggaaagcggagaagtggcaacctgccgaatgggcggagctgtttgccaaagcaggtgcaaaatatgtggtgctgaccaccaaacatcatgacggtttctgcttatatccaagtaaatataccgatttcaactgcactgaagctggtccacaacgtgatttgatgggcgagctgactgataatgtgcgtgaaaaagggctgaaaatgggagcttactactctggtattatagactggacctactcttctgcaccgattttcaccgagagtcaaaacttttccaatgcttgcccaacctatgaatacgccgattacgcttataaacaagtggttgagctgattgataaatataaacctgatgtactttggaatgacatcggctggccgaaagccggtgaacatatgcttccgcacttgtttgctcactactataacagcgtgccacacggtgtggttgatgaccgttggaacaagctctggtgcgatttcacctcaaaagagtacaaacacggcgtggcttcgcgtgataaaaaatgggaaatgtgccgtggtatgggcttatcatttggttacaacaaagtggaagatgaaagccacttgatttcagtgaaagatctgatttcgctcttagtagaaaccgtggcagacaacggtaacctgttgctcaacatcggcccaaaagcagacggtactattccacaagagcaagttgaacgcctactctccttgggtaaatggttggagcaaaacggtgaagggatttatcgctcccgttgcagtaaatattcccccgaaactgtaaacggtgtaacaatgattgcccaccctcagaacgaccaaaatcgcacgtcttaatcgttccgagtgctgtatcgttacaacaaacagcggctgtttaaggaatccatcagcagcgtgggcgtgttaaaaactgtttgcattccttaaaaaaatacatataataataattcttatttgcatattttatataatataagaaaggatataggtaaatgacctctttcaaattattaggcttttcggtcttgagtgtggctgtgctctctgcctgctcttccggcaaaggtagctttgatttagacgacacccgccatacccccccctcctcatcgggtagttcccgccccactcatcaagacgttccgactggacaacggcagcaagaacaagtagaagaaatcaaccaacccgccctaggttatgccacaaaaattccgcgtaggaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgctacaaaattgatgctgatatcaaaggcaatcgctttgtcggttcggcaacggcaaatgaaaagactcacaccattttcggcaaggatgctaaaaaccgtctcgagggcggtttctttggtcccaaagccgaggaactggcaggtaaattcttgacggatgataattccctgtttgttgtctttggtgcaaaacgtgannnnnnnnnnnnnnnnnnnnnnnnnnnnnnnnnnnnnnnnnnnnnnnnnnnnnnnnnnnnnnnnnnnnnnnnnnnnnnnncgatggacacgttcggcaatgctgcgtatttagtgttggacggcagacacttccccttgttgccggaaagtaatgccggtacgacgggcgctagcaacacaggcaagaatgatttcatctctaccatagatggtaacagtctaaagacgaaaaaccatgagaatcacaaaaaatacaaagttaccgtatgttgcagtaatttggtgtatgtgaaattcggcagctatggggaacaaacaacagcaaacggtgctgcaaacagcactgacggtacatcaattacgcataacagcacattaacaaacgggcaccttttcctaaccggtgaacgtacttcgcttactgatatggcgaagcaaagtggtgcagcaaagtatattggcacatggcaagccaactttttaagtagcaaaggacaggttggcagtgttgacgccggtgatccgcgtaataatagtggtaaaagccgtgctgaatttgatgttgactttggcggtaagacagttgcaggcaagttttttgatgccgacggtactcaacccgccctcacaatggaaaaagccacgattacagataacggattctccggcacggctaaaacaactggtggtttgccgctagacaaaggcagtacaggtgcgggtaccaaagtaatcttcaccgatgctaaagtcgagggcgcattctacggtccgaacgctgaagaaatcggcggtaccatcacatcgaacggcacgggcgacaaagtcggcggggtgttcggcgcgaaacgccaagaactatcgaaatagaaatgaaatcttaactctagctacctgaaacacaagtcaggtagcgggatgggtatctgctgatatggtcaacctgcttgaaaaagtttgtcaaatccgtcgcctgtcgttgttgacggtgtgatgttgcagtggcaaatcgctcggctctgttgagaaagcatgacccatccgtcttttactcacacggaatgaaaaaaatgtctacaaaacctttgtttaaacttaagccaataacattggctgtcagcacgatttttttaccttttactgaggcggttgccgatactgaatcaccgagtagcaatacagaagcagtgctggagttagaagctatccaggtgcaagccaaacacgagatcagcagacatgacaatgaagtcactggtttgggtaaggtggtcaaaagcagtgaagacattgataaagaactgattttgaatattcgcgatttgacccgttatgatcccggtatttcggtggtggagcagggacgtggtgcaacgtcaggctatgcaatgcgtggtgttgacagaaaccgcgtggctatgttggtggacggcttgggacaggcacagtcgtattctaccttgaaatccgatgccaatggcggggcgattaatgaaattgaatatgagaatattaagtcaattgaattgagcaagggatccagttcggcagaatacggtagcggtgccttgggcggtgctgtagggtttcgtaccaaagaagctgatgatgtgattaaagaggggcaaaactggggcttgaacagtaaaacggcttacagcagcaaaaacagccagtttacccaatccgttgccggtgcgttccgtgtcggcggttttgacagtttggcgatttttacccatcgtaaaggtaaggaaacccgcgtgcatcctgccgccgaagaaatacaacatacttaccaaccattggaagggtattttaatcggtatgatgttgaccaaagaaacggaacgcctgttcgggcgaatgcgtattatatacttgccgatgaatgctctaatctaagtgatccgaattgtcgtcatgctaaggccaagacgaatttgtcgggkgtgctggagaacaatcctaattggacgtccgaagagcaggcgcaggctgctaaaatgccgtatccgacacgtaccgcctctgccaaagattatacgggtcctgaccgcatcagccctaatccgatggactaccaaagtcgctctttcttctggaaaggtggttaccgcttgtcgcctaaccattatgtcggcggggtgttggagcatacgaagcagcgttacgatatccgtgatatgacgcaacgggcgtattacacgaaagaggatatctgccgcagcggatccagttgccaaacgttggataaaaacgatacggacaaaggtaatttcggtatcacgttgactgataatcctttggacggtttggtatatgatgccggcaatcaagcgcgtggcgtgcggtacggacggggtaagttttttgatgaacgccatacgaaaaatcgctcgggtattttttaccgctatgagaatcccgataaaaattcttgggcagatagcttgaccttgagtattgaccgccaagatctcaaactatcgagccgtatccattggacgtattgcaccgattatcctcatgtggcacgttgccgtgccagcttggacaaaccttggtctaattaccgtaccgagaaaaacgattatcaagaacgactcaatttgggacaattcaattgggaaaaaacttttaatctgggctttaccacgcataaggtgaatatcgccgccggctttggtacacatcgctccaccttacaacatggcgacttatatgctgaatatgtcaccttgccaccgtatgaggaagtaaaagtgtatgatgataaaggtgcctttaaaacagatccgacaccagaggagaaattacaatacggcaatggttcttataacaaacctcgcgtatatagacgtaaaaacacgccggaattaaaaactgtcaatgggtgcaatgagacagcaggtgacaatcgcgactgcacgccacgtgtgattacgggcagacagtattaccttgccttgcgtaaccatattgcctttggtgaatgggcagacttggggttgggcgtgcggtacgacaaccatactttccgctcgactgacccgtggaccaaaggtggcaactaccacaactggtcgtggaatgcgggcgtgagcctcaaaccgacccgccactttgtcgtgtcttaccgtgtgtccagcggtttccgtgtccccgctttttatgagctgtacggcgtgcgtacgggggcttctggtaaagacaatccactcacacaaaaagagttcttgagccgtaaaccgttgaaaagcgaaaaagcctttaaccaagaaattggtttggccgttcagggagattttggtgtgatagagaccagtttcttccaaaacaattataaaaatctgcttgcccgtgcagataaacatgtcgagggattgggttatgtaaccgatttttacaacacccaagatgtcaaactcaacggtatcaatatcttgggtagaatctactgggcaggcatcagcgataggctgcctgaaggcttgtattccacacttgcttacaaccgtatcaatatcaaagcacgcaaattgcacgacaattttaccaatgtgtctgagccgacattggaagccgtgcaaccgggacgcattattgcaagtatcggctatgatgaccctgagggcagatggggccttaatttaagcggcacctactctcaagccaaacaacgtgacgaagtggtcggcgaaaaagtgttcggcaagggtggcagcattaaacggacgatcaacagcaaacgcactcgtgcttggtatatttatgatttgacggcatactacacttggaaagaaaaattcacgttgagagctggtatctataatttaaccaatcgtaaatatagcacatgggaaagtgtgcgtcagtcctctgccaatgcggtcaatcaagacctaggtacacgttcggcacgttttgccgcaccgggcagaaactttaccgtgagtatggaaatgaagttttaattaaaaaactgtctgcaagctgtttaaaaaacagttaagatgatttgttcgtataaatagcagcttgaagtcttgttatgcaggttcaggcagcttgacattccaaaaaaaggaaaaaagtctaatggaagacaataggctatttgtcggcaacgaaattaggcaacgaaaaattgttgcaatggattagcagttcaagtggcttccggtattttttatcgcactttttctatctataagcttgaaatctttatttccgaacttatattttcgctgtttgttaatttcactattggaaaaggaaatattatgtcaacaaatcaagaaacacgtggttttcagtctgaagttaaacagcttttacaattgatgattcattctctttattcaaataaagagatttttttgcgtgagttgatttccaatgcgtctgatgcggcggataaattgcgttttaaagccttgtctgcacctgaattatatgaaggagatggtgatttaaaagtgcggatcagttttgacgcagagaaaggtacgttaaccattagcgataatggtattggtatgacgagagagcaggtgatagatcatttaggcactatcgctaagtccggaacaaaagaatttttggccgcacttggacaggaacaggctaaagataatcagttgatcggacaattcggtgtcggtttttattcggcatttattgtggcagataaagtaacagtgaaaacgagagcagcaggtgagccgatagataaagcggtgttgtgggaatcagccggtgagggtgaatattctgttgctgatatcgagaaaaaagaacgtggtacggaaattactttgcacttacgtgaagaggaaaaagagtttgctaatgaatggcgtgtacgtgaaattatcggtaaatattctgatcatattggcttgcctgttgaaattttagcgaaagaatatgatgaagaaggtaaagaaacgggaattaaatgggaaaaaattaataaagctcaagcactttggacaagatcgaaaggtgagatttccgatgaggaatataaagagttttataaacatttaagccatgattttgctgatcctcttttatggacacataataaagttgaaggaaatcaagaatataccagcttgctgtatgtgccgtctaaagccccttgggatttattcaatcgtgagcataaacatggtttgaaactttatgtacagcgtgtatttattatggatgatgctgaacaatttatgccgaattatttacgctttatgcgtggcttaattgatagcaatgatttgccgctaaatgtatctcgtgagattttacaagataataaagtgacagctgctttacgtaaagcattgaccaaacgctcattgcaaatgctggaaaaattagccaaagatgacgaggagaaatatttacaattctggaaagaatttggtttggttttgaaagaaggtccatcagaagactttgcgaataaagaaaatattgccaaattattgcgtttcgcttccagtaaaaatgatagctcagaacaaaccgtttctttggaagattatgtcgctcgtatgaaagaggggcaaaaggcaatctattacatcactgcagatagttatattgctgctaaaaactcaccgcacttagagctgttcaataagaaagatattgaagtattgttgttgtctgatcgaattgatgaatggatgttaagttatttaactgaatttgacggtaagcaattacaaccgattactaaagctgatctggatttaggtgatttagcggacaaagaacaggaagagcaaaaagagcaagataaaacctttagttcgtttattgaacgagtaaaaaccttgttgggagaacgtgtaaaagatgtacgtttaacgcatcgtttaacggataccccagcagtggtttctactgataatgatcaaatgaccacgcaaatggcaaaattatttgcagcggctggacaacctgttccagaagtaaaatatacgtttgaacttaaccctgaacatcatttagtgaaaaaagtagcagatttggctgatgaagacgaatttgcaaattggattgaattactgcttgaacaagcaatgcttgctgaacgtggttcattagaaaatcctaccgcatttattaagcgagtaaacaatttattggggtaatggttgtttcttagctgattgatgtaataaaactctctaatttattagggagtttttttatctatgtttgacacttgtagtaaaaaagtgcggtagtaaaatagcatttgaatagttaaaaaaatgctaacaatggaattttcacgtataattcggaatcgggttttattgaccttttatagaaggattgttgatgaaaaaaattatcttctttggcactgttatttggctcactgcttgtacaacaactaatttaccaccaagttgccaacgttatttcaatgcactggagaaaaacatggcacaattttctctgtcaaatgctgaattggctaagtttaaacaaaataaaaataaattaagccaattaccggaaaaagaacaaaataaaatttgccttttaagaatggcaagtatgcaacaatataaaaattgatcgtttctgatgtgttcaagtctttttacggaataaatatgactacttttgtcgcttggggcaatattcaacaatcgtatccttttgaaacaatacctttgcagttactgaatgaaaaactgacgcatttagcaagtaactatacacctgtgcggcaacgttatcattgtcgccgtttggcacattttttattgtggcaattgttgcaaaaagccggagtgaataccgcacttttaggcgatattaaacgttcttcatctaatcgcccttactttttacaaaaccatattgattttaatatcagtcattctgatgattgggtagcagttgttttacaagttgatgaaaataatgataaaagtgcagtaggaattgatattgagtttgtcaaaaaaacaagaaattacaccgcacttttacagcattttgccagacggcaagaggtgatttggtttcaacaaaagccttgcgaggcacgtttttatcaaatttggtgcggacgagaggcattgttgaaatcgcagggcgtaggtattgtcaaattatcggaagtcaagcatgaaccggagaaattattacttcattccgattattgcccaacgggaaagctcatatttacggctgagttgcctttttattttgcacttttttgtcatcaacatattgaacaaacacaatattttatgtggcaagataaccggtttgtttcaaaaaaactgacgcaggcaattgaatatcaagtgaatcctttaaagcagttcattcaaatttaaagtcggttttcgttgcataataaaaatgaggtagagtattgctcaaattgaatttacgaagattaaattatcaaaggacaacagagtcatcgtgaaattgcggtagaaattcaggactttttaagtggtaacaaaaagcctcatcaataaaaatgaattgataaggctagaaaatttggtggagataatcgggatcgaaccgacgacctcttgaatgccattcaagcgctctcccaactgagctatatccccgtaaactgaatgtggcggctatgataaattccgccacacgtactgtcaatatagaatattaaatattttttttaccagcttaaatattaagcattttgtgtatgaataaaggcaatcgcattatttattctgctaattgtacgatctttaccaaccaatttcgctgtaatatccattgatggcgattgtcccaaaccggttactgccaatctaaatggcatacctactttacccataccaatatcaagctcttgggcggtttggttcattgcttcatgaatattttcaactgtccagtctgaaagtgcggtgagtttttcagccaatttagctaatggtttaatcgcatcaggcttaaagtttttagctacagctttttcatcatagttttcaaaatcttggtaaaaataacgacttgaggttgctaactcttttaatgttttacaacgttcactcaaaacaggaacaatctcagctaagtccggaccattactataatctatgccttgttgcttcatatgccattccaaatgggtcgcaacctgctccgctggcagagaacgcatataatgttgattcagccattgtagtttttcagtattgaatgcacttgctgatttgctaaccgaatgaatatcgaaaagtgctatcatttcttctcgactaaaaatttcttgatcaccatgtccccatcctagacgaacaagataattgattagtgcttcgggtaaataaccttcatctcgatattgcataacacttaccgcaccatgacgcttagataatttttgaccatcatcaccgttaatcatagagacatgagcataagttggaattggtgctcccaatgccttaagaatattaatttggcgaggtgtattattgatgtgatcttcaccacggacaacatgcgtaattcccatatcccaatcatcgacaacgacacagaaattataggttggcgaaccgtctgtgcgacggataattaaatcatctaattcacgattgctaatttcaatacgcccacgaacggcatcatcgaaaacaactgtaccttccgtcggatttttaaaacggacaacgtgaggtgcatcaactgggtattcactttgatgtaagcagtagcgatcatagcgaggtttttgtttattttgctcttgactatgacgtaggtcttccaaacgttctttagtacaataacaacgataagccaatccttgctcaatcatctgatcgattacttggttatagcgttcaaaacgttttgtttgaaaatacggtccatgttcccacgctaaattaagccattccattccctctagaattgccgctgttgcttcaggggttgaacgttctaaatccgtatcttcaatgcgtaatacaaattctccttgattatgcttggcatacaaccaagaataaagtgcggttcttgcaccgccaacatgtagatagcctgttggacttggtgcaaaacgtgtacgaactttagtattgggatctaaattaaaaagtggttctaatttcattcattttgcctttatttaatcaatcataaaacggtgcttattgtacaatgagttatttaatttcataagaaaaaattaaaattatgtttatttttaagacagttaaatagaaatccataaaaaatcattgactgttttttgataattcttataatgcacctcgcacaatacaagggcgattagctcagttgggagagcacctcccttacaaggagggggtcactggttcgagaccggtatcgcccaccactattctatagtgaactttgtattgtaatattggcttaaggggcgattagctcagttgggagagcacctcccttacaaggagggggtcactggttcgagaccggtatcgcccaccactttagccggatttcccatttgactttaagtcaaatccgatagctgaaaagcaatttgattctatcgggcgattagctcagttgggagagcacctcccttacaaggagggggtcactggttcgagaccggtatcgcccaccaattcaaaaaatctaaatttttccacgttgttaaacttattacaactttcgggttgttgtcttttttatctatatttttaactaattattgttcacttttgcgatcttgatcgtaaaactacgatacttgcaaaaaagttttttcctgattccattaaaattattttttatttaacgaataggaaaacatatgcagaatttgaagctattttcttggaaagccactaattttttacagcaaaaacaagctggaatgcttgttatcgaaaatgtacaagaggccaaacgctatttattacaacaagggctaaacaatatatatttacagcgtcattggcaactgaataaaaagcctaaaaaaatagaattttgtgatctattaactcaactagcaatgttattacaatcctcaattcctttaaaagatagcttacaaattttattgagaaattgtgttaatatttctttaaatcaatgggttagatatattttaaaaaatcttgaaggaggattatctttttcacaatctgtggctcaatcaggtctatatttttcttatcaagaacgccaactcatttctgttggagaaatgacgggagatttagcctctgtttgccaacaaatagcagaacatcgtcagcaggcattagcattacaacgcaaaattcaaaaaattttactctatccaatgatagttttaagtatttctatcattctcaccgcacttctattaatttttatcgtgccacaatttgccgaaatgtacggttctaatcaatccgagcttcctttttttacgcaactattgttaaacatatcctcttttttacaacagtatttttttcatatgatagcggtatctattttatttttttatctaataaaattacgtttacacaattcatatagttttcaactcaaaaaagattggtttttatcgcatgtgccgttgttaaataaaattattcggcttaatagaacgataagtttttgccgtagtttaggattaatgctcaactcaggcattcctttacaacaaagtctatattctttccttccccaaaactctatcaacatacagaaaaagattgagggagatctcacgttaattaatgaagtaaagctaacattacgtggtatcgaacaaggatataaattctctcagtctgtaagcagtaatttgttttctatacaaacacaacaaatgctacaagttggtgaaaagagtggaaatctaggtttaattctgcaacatatcgcagaaaatcagcaacaacagttagatcatcaaattgatttactttcacaaatgttagaaccgtttatgatggtgatcattggcggattaataggcttgattatgttaggtatgtatttaccaatctttaatatgggaagtttaattcaatgatttatctagcttatatgttgtttggtggactttgtgggttatgggtttacctttatgtcaggcaattttctgctcagattaataaacaagtttactcgactttttgcgaaattttccccgaaaatgcaccgcacttgatgcctatgtctatcttacgacggaaaaagtgcggtcatttttctatgtattttttgtgtggtggcctttggtgtaatatatgtttaaatttcccacaaaatatttatgttggtttatggttagcatgttgcggttatttaattttttgccttgttttagtggattggctataccaactcgtttcacaaaccttatgccaagccctatttattttagggttattgggtgcttatcaaggtattagcccattgactttggagcagtctttaattggtagcttatcaggcttttcggttttttatcttatttacattgttgcaaaattattctatcgttatgaagctttaggacgtggtgattactggttaatgttagggttagggagctttatatcttggacaaaattaccgttgctcatttttcttgcctgcctcacaggattaatatatgtcgtttttaatgcaagagacaaaaaaacaatatttattccttttgccccgttcttatgtctctcaaccattatcgtatacttgcttaattttctaagggaggatattcttccttaaattttagggaaagaagaatatggcttatattgtagggttaaccggtggtatcggtagcggtaaaagtaccattgcgaatcttttttcagaactaggcgtacctattgtggatgccgatgttgtcgctcgagatgttgtagcaaaagattccttaatattagagaaaattattgctcattttggtgaagaagtgcggttggaaaatggtgagttaaaccgatctgaattgcgtaaattggtatttcaaaatgaaaaagaaaaattatggctaaataatttgttgcatccggtaattagagaaaaaatgctacaacaattacgctctgttaattatccttatgtgctttgggtcgttcctttactcattgagaataagctaatgaaattatgcgatagagtactggtaattgatgtagagcctgaactccagattttacgagcaagccggcgggatagtaattcgattgaattgattaaacaaatgatacagtcgcaagtaaatcgtgagttacgtttaagttttgctgatgatgtcattgaaaataatctaccccttgaaaaaaacgtggctaatttaaaacaaagcgtagcaaaattgcaccgcacttatttgcattatgcgaagataatttctagaaatagtgaagaatttgaggatataaaatgattgatgaaaaatttactgtagcctgtcccaattgcaaaaaagaagtactttggtcagaggaaaatcgatttcgtccattctgtagcaaacgttgtcaattaatcgacttaggtgaatgggctacagaagaaaagattattcccggttcagaaataaccttgttaccgaacgatgaatttaaagaaaattgagagttatgaatggatarataaataaatagataaaaagaatattgagattttaatttgggcttgttagaatcagcccacttttattttgataaataaaaatatagttcgaatgaaggtagctggagaatggggaattgaccccaaaccgacgaggtaaaatctttcaggtgcgatggcgaggactgttactggacgaacccttggagagatccaatgtgcaatgcacaaaatggacgccgaaggcgcaaaagagcggtgttttttactgcttttcaaacgctcaggcaaaaggacaggggcaaaagattcttttcggatagaaacgttgcatagcgttttttctttattatcccaaaaacttttcgcctccttgtaaacacacgttattttacgaggaatacttatgtcattagagataattttatcgtctatcaatacttttgtttggggacctcccttacttcttcttttatttggtacaggtctttacttgaccttacgcttaggatttattcaaattcgttacttacctcgtgcattatattatttatttgataaagaacgtcatgtaagtaaaaaaggggatatttctgctttcgcagccctttgtacggctttagcggcaacaataggtacgggaaatattgttggtgttgcaactgctttgcaagccggtggaccaggggctattttttggatgtggttagttgctttacttggaatggcaactaaatatgctgagtgtttattagcggtgaaatatcgggtgcgagataaacaaggttttatgagtggcggaccaatgtattatattgagaaaggcttaggaataaaatggcttgccaaattttttgccgtctgtggtgtattagttgcatttttgggcattggcacttttcctcaaattaatgcaatcacgcatgctatgcaagatacctttaacgtatctattgaaattacagcaaccattattaccgcacttattgcacttattatcttaggcggtgttaaacgcatttcaacagttgcatctattatcgttccttttatggctgttttatatgtacttacgtctttgttaattcttatactaaattggcaacaagtaccaactgctataggattaattattcatagtgcatttgatcctcaagcagcattaggcggtgtatttggatatactgttctgaaagccattcaatcaggatttgcaaggggtattttctctaatgaatccggattaggtagtgcaccaattgcggcggcagcagctcaaactaaagaacctgttcgtcaaggattaatttcgatgataggtacttttttagatactatcgttgtgtgtactatgacaggtatcgtgcttgttttaacaggtgcatggcaatcacaagaattggcaggagctgctttaactaactatgcattttcacaagggttaggaaataatattggtgcaacaattgtaactgtagggttactgttttttgcttttaccactattttaggttggtgttattacggagaacgttgttttgtttatttggcaggtgtcaaaggtatcaaagtttatcgttcaatttttatacttttagttgcctgtggtgcctttattaaactggaattaatttggattttggctgatattgtgaatggtttaatggcatttccaaatttaattgctttagttggattgcgacatattgtgatcaatgaaactaaagattattttattcgcaggaaacaaatatttgttgagccaaataatgtagctaattgagcaaaaattaaaggggctgacggcccctttaaatttctctacatcagaccatcatatcaacctcaaataaaaataaaagtgattttttataaatatgataagtagatcatactttttcatttttattcctaaaaagtgaaaaaacaccttgaaaactcctgctaagaggactattttgtaactaagaatttttctgagtggaaacgctcatcaataagcaaaagaggtaaaagctatgactctaaatatcacaagtaaacaaatggaaatcacccctgcaatccgttcacatatagaggaaagacttgctaaattaggaaaatggcaaactcaattgattaatccgcattttattttaaataaagtaccgcagggttttgctgttgaagttgccataggtacgccttatggcgatttattcgcaagtagcgagtctgatgatatgtacaaagcaattaacgaagttgaagaaaaattagaaagacaattgaataaattacaacataaaggagaagctcgccgagctagtgaaagactaaaagactcgttttgataaatgagtttgtctaaaagtagagtgaaaataaaacgctctatttattgtgtaatgaattttacttattgtatgttacctatttgaacctaccaaataagtagcgtaaatcgtggcttctcgtaagtcctaaaaaagctgatgtttaaacttcagcttttttgttagaatatatcggcgataaattttattaaggaatgaagatgaaaaaacatcatgttgacgttttaattactgaggaagatgtacgttcacgtattcaagaattaggtagagaaattacacaattctatcagcataaacacgtaaataaattggtagttgttggattattacgtggttcatttatgtttatggctgatttagtaagagaaattaaattaccgattgaaattgaatttatgactacttccagttatgggaatgaaatgacaactaatcatgatgtacgaatagctaaagatttagatggcgatattaaaaatgaagatgtattgattgttgaggatattattgatacaggatataccttagaaaaagtgcgggagattttattgctacgttcgcctaattcattagcaatttgtactctattagataagccatctcgccgagaggtagacgttcctgttgaatgggttggatttactattcctgatgaatttgttgtcggctatggtattgattatgctcaatgttatcgtaatttaggctatatcggtaaagttactttggaagaataagttaccgaaaaggaaatgtttctatcaaaaattaaacaaaaaaagagattaaaaaatctctttttttacacattctttaagaaaaaataactatatagataaaattgaaaataattagaaattatcttcaagcattgttaatttttttctcaaagcgttcagcagcagcatcccaattcaccacattccaaaatgccttgatataatctagacgacgattttggaattttaagtagtaagcatgttcccaaacatctaataccaaaatagggaaaccttcgcaaccggcaatttcttttcccattaatggactatcttggtttgcggtagaaaccacttctaatttgccttgatttaatactagccaagcccaaccggaaccaaagcgagttgcagcggctttctcaaactcagcttggaaactctctactgaaccaaaatcacgctcaatagcgtcttttaatgggccttgtaaagttgtacctgtttttaaacctttccaaaataaactgtgatttacatgcccaccaacattattgcgaatagcagtacgtttatcagcaggaacttcgactaatttggtaattaattgacccggacaaagatctgtaaactcaggtaaagtttctagtgctgcatttgcattattaacgtaagtttgatggtgtttactatgatggagttccatagtttgtgcatcaaagtgcggttctaaagcatcataagcataacctaattcaggtaaagtataagccataacaatttccttctataaaaaattctgaataataaactcggcgaattctagcaaaaaatttgatcaagatcattaaaagtttaatttttttaaaaagccctaccgcaagataggactataatagattaaaaaacattcaacgattctgtgcttttaccgctgcaacggctaccatattaataatacggcgtactgatgaagcagaagtaagaatatgtgccggtttttccacacccattaaaattggtccaattgtaattggtgttgctgtaccttgtaataaattcaagctaatacgggcagtttccatgttgggcataatcaataagtttgccgcccctttaataggactgtcaggcatcacttccttacgtaaattctccgataaagcaatgtcacagtgcatttcaccatcaataatcaaatccggtgctttttcacgcacaagctctaaaacttgccgcattttaaccgcacttgggtcattaattgagccataatttgaatgtgaaacaagagcaacctgtggctctataccaaaacgacgaacttctttggctgacataatcgtgatttctgcaagttcctcggctgttgggcttgagttcacaaaagtatctgcaataaataaattaccggtaggcaaaaccagtccgtttaccgtagctggaatttcatgttctttttcaccaacaacttctttaattgtagttaaatgtgcagcaaatggtccaactaatccgcaaatcattgcatcaactttacccagttccaataaaactgcaccaagtgcggtcggattatgaagcattttgcgtttcgctccggtaggtgtcataccttggcgttttaatttgttgtaataagtatcacaacattcctcgtagtatggattattttcaatgtcaataatctcaaaatcacgtccgagctgtaattgcaaacccaattttttaatactttcctcaataatatgagtacgacctaataggacaggataggctatgcctaaggttgcaatttcttggattgcatgtaacacacgtttttcttcgccatcagttaaaataacacgttttttatcttctttggcttgtgcaaaaacaggtttcatgaataagttggttttataaacaaactgagttaatttctcaatgtacgcttcaaaatcttcaattggacgagtagcaacaccgctatccattgccgctttagctacggcgggtgctatttttacaattaatcgaggatcaaacggttttggaataatataatccggtccgaaagaaacaccgctctcaccataggcggaactgacaacctcgctttgttctgctaaggctaaatcagcaattgcataaactgccgcaagtttcatttcttcattgatagtcgttgcactgacatctaatgcaccacggaaaatgaacgggaagcataacacattattcacttgattcggatagtcggaacgaccggtacaaacaatcgcatcaggtcgaacagcttttgctaatggcggtaaaatttcaggctcaggatttgctaaggctaaaattaaaggattaggccccattgtttttaccatttcttgagtaagtgctccagcggcagaacaacctaagaaaatatctgaatctggaatggcatcagctaaagagcgttgaccgttatcatcaatagcatataactttttggtgtcatccatttttttgtcacgacctttataaatgacccctttagagtcacaaaccgtgatattttcacgtttcatgcctaatgaaaccaataaatttaagcacgcaatcgatgctgcacctgcaccggaggcaactaaacgaacattttcaatttttttattaacaatacgtaatccgttaattattgcggcggctgaaataatggctgttccatgctgatcatcatgaaaaacaggaattttcatacgttcacgtaatttctgctcaatataaaagcattccggtgctttaatatcttcaagatttatccccccgaaagtcggttctaaagcagcgataatttctaccaacttatcaggatcttgttcatctacttcaatatcaaatacatcaacaccggcaaacttcttaaataaaacacctttaccctccataacaggcttaccggctaacgctccaatatttcctaaacctaatactgcggttccatttgatatcactgcgactaaattgcctctggaagtatatctataagcagagacaggatctgcttggatttctaaacaaggtacagccacccctggagaataggctaaagctaaatctcgttgtgttcccaatgattttgttggtgtaacttcaatttttcccggttttggaaactcatgaaaatctaaagcggcttgacgtaattgtgcatccataatttttcctcatattaactatttacttcatttcaactttactaaaaaccaatttcattataggcaaaaaaataggcaaaaaagtaacacraaaattttatttacataatttaccaaattgtacgatgtatagaatcaaatacaaaaataggcatatatttttactatatgcctattggaactaaagaacaattttacttatgtaatgtagctttgtaggttgggttcattaaattctccacagaaagaatattatctaactgctcttctgttaataagcccatttccagtacaacttcacgcactccacgtcctgttttagcacatgttttacctactatatcgccattatgatgaccaataaacggattcaaataagttacgattccgatggaattaaagacataattttcacaaatttctttatttgcagtaattccatcaatacatttatcacgtaaattcacgcaagcatttgttaaaatttcaatactttcaaacatggcttgaccaattaccggttccatcacatttaactgcaattgccccgcttcagctgcaaaagttacggtagtatcattaccaatcactttgaaacaaacttggttgactacctcaggtacaaccggattgacttttgccggcataattgaagatccagcttgtaactcaggtaaattaatttcatttaaacctgcacgtggacctgatgaaagtaaacgtaaatcattgcatactttagataattttaccgcagtacgttttaacgcaccgtgtaccataacataagcaccacagtctgaagtggcttcaattaagtttggtgcaactgtacaaggtaaacctgaaacctcagataaacgcttaacaactaattctgaataaccttgaggagtatttaagccggtaccgatagctgttgcacccaaatttacttctaacagtaattcagccgtgcgggttaaattacgcacttcttcatctaataatacagaaaacgctttaaattcttgccccacagtcataggaactgcatcttgtaattgagtacgtcccatttttaagatattcgaaaactcttttgctttattttcaaaaccctgttgtaaataaagtactttagttaccagtttcataatactgttataaacagcaatgcggaaacctgtcggataagcatcatttgtagattggctggcattaacatgatccatcggatctaaaatatcatattcccctttcttatgacctaaaatttctaatgctaaattagcgaccacttcgttggtattcatatttacggaagtaccagcaccaccttgatatacatctgaaggaaattgatccatacatttaccatcaattaaaatcgcatcacaagctttcacaatcgcctgagcaattttatccggaattgcacccaattctccatttgcaagtgcggttgctttttttaccatgaccataccacgtacaaattcaggtacatcagaaatcgttacattagaaatgttaaaattttctaccgctcttaatgtatgaatgccccaatacgcatctgctggaacgtcacgttcaccaagcaaatcaatttcttttctcgttatcatatttctttcctttttaatttttcagactaaagaatgtaagtcattataggatagatagtcgtttaaaaatgtgatcccgatcacttttcagcactcctctcaccaatatattttttataaaattcattagttttttttatggaaaattaaataaaaaatacccttgaaagaaccaaaatatcccccatatagggtgagctttaattttttattaattattaataaggaacccaaacaatgaatattcgtccattacatgatcgtgtcatcattaaacgtgaagaagtagaaactcgctctgcgggtggtattgtcttaaccggctcagctgcaacaaaatccactcgagcaaaagtattagctgtgggtaaaggtcgtattttggaaaatggtacagttcaacctcttgatgtaaaaattggtgatactgtgattttcaatgatggatacggcgtaaaagcagaaaaaattgatggtgaagaagtgttaatcatttctgaaaatgatattttggcaatcgtagaataaaaacaaattaaattaataggaatacagaaaatgacagcaaaagacgtaaaatttggtaatgatgctcgtgtaaaaatgctagcaggtgtgaatgttttagcagatgcagtaaaagttactttaggacctaaaggtcgcaacgtaattttagacaaggcttttggtgcacctactattactaaagacggtgtgtctgtggctcgtgaaatcgaattggaagataaatttgaaaatatgggtgcacaaatggtgaaagaggttgcctctaaagcaaatgatgctgcaggcgatggtacaaccacagcaacagttttggctcaagcgattgtcagcgaaggtctaaaagcagtagcagccggaatgaatccgatggatttaaaacgtggaattgataaagcagttaatgcagtggttgaagagctaaaaattctttctaaaccttgtgaaacgtcaaaagaaattgaacaggttggtacaatttccgcaaacgccgatgaaactgtcggtaaacttattgctcaagcaatggaaaaagtcggtaaagagggggttattaccgttgaggacggttccggtctttcagatgaattggatgttgttgagggtatgcaatttgaccgcggttatttatcaccatacttcattaataaaccggaagccgcaactgttgaattagataatccgtttattcttcttgttgataaaaagatctctaatattcgtgaattattaccggtcctagaaggtgtagcgaaagctggtaaaccattgttaattatcgcagaagatgtggaaggcgaagcacttgcaacgttggttgttaacacgatgcgtggtattgttaaagttgctgcggttaaagccccgggatttggagatcgtcgtaaagcgatgttacaggatattgctatcttaactgcaggtactgtcatttcagaagaaatcggaatggagcttgaaaaagcaactcttgaagatttaggtcaagcaaaacgtgtggtgatcaacaaagataacacgactattattgacggtattggtgatgaagctcaaatcaaaggtcgagttgctcaaattcgtcaacaaattgaagaagcaacttccgattatgataaagaaaaactacaagagcgtgttgcaaaattagccggcggtgttgctgtcattaaggttggtgcggcaactgaagttgaaatgaaagagaaaaaagatcgtgttgatgatgcgttacatgcaacgcgtgcagctgttgaagaagggattgttgccggtggtggtgttgcattaatccgtgctgcaacaaaagttgcaacaacattaaaaggcgataacgaagatcaagatgtaggtatcaaacttgctttacgtgcaatggaagcaccacttcgtcaaatcgtaaccaatgcgggagaagaagcttctgtagttgcaagtgcggttaaaaatggtgaaggaaacttcggttataatgctggtacggagcagtatggtgatatgatcgcaatgggaattttagatccgactaaagtaactcgttccgcactacaatttgctgcatctatcgcaggattaatggttacaactgaatgtatggtagccgatctgccgaaagaggagaaagctgatctgacaggcggaatgggtggtatgggcggaatgggcggtatgatgtaattctccccatattccatatctaatcattatgttaagaagggtcgtcagaccctttttatttttcaaaaaacgtagaccttaattattagctatctagaagtctagattgttattttgcctattttttattagaatactcaatattactaaggttattaaggatcaacaaaatggcagattgggacggaaaatatattagcccttatgcagaacatggtaaaaagagtgaacaagtcaagaaaattaccgtttctattccaattaaagtattagaaattttaactaatgaacgcactcgtcgccaactccgtaatttacgtcatgcaacaaatagtgaattattgtgtgaggcgttcctgcatgcttttaccggtcaacctttgcccacagacgaggatctattaaaagaacgtcatgatgagattcctgaaagtgcaaaacaaattatgagagaattaggaataaatcccgatgattgggaatattaatagattaagtttggtaagttatttcagcaagtgcggtcgttttgaccgctttttcgctttttattagtgaatttcactcgggaatgttacaatccgctaccgttataacaatagagataaatacaatggctcgtacaaaaaaaactcgtcgaataacagatattatgcccatgcgtaaaacagataaacgtccggaaaatctgtcacgccccggtaagaaacttactcgttatgaacttgatgctaaatctcgtgaagaaaaaaagaaaaaaaaacgtaaaggactaaccgctggttcacgtcatagtgcagtagatacaagtaaaacaatcgtacttaatgaaaaaaaagatcctcgtgttgggagtcgtaaaaaagttcctcttattgttgaatttgtgaataaacctgaaaaaggtatgtttattccttcaggtgctttagaggaaaaagcgaaaactattgatccgatgctggaactgacacaactcgaaaataatgaaagtttaaatcaattattagatgagcttgatgcaggtaaaaccttaagtaaaaaagatcaaatctttgtcaatcaatgcctagaccgtattgctcaacttatggctgaacttggaattgaagaagaaaatgaagatgatttgtaccgcacttttgagactattgatattaaccaatttaaataagctatgtggatcacaattttaatcattctcggcggattaattattagcgttatgcttggttacgcaatatatttattgctcgttttacaaaagcagaagaaagtttttttgcaagcaaaacaggctagactaaagcgtttaaaagaaagttgtgaaattatcgctaatgcaatgcaaagtggagaatgcaatttatctgaaggtgttatccgtctaaaaatgttgcttgaaccgttagggcattcattgaaaaattacacttcaatgtaccaactctatgaagcagtaatggatatgccgacccatgatgctcggcgaacattaaagaaaaatgaacgtatgcgtttagatttacaacgtgaacgtgctgaagctgatttagaacaaaacatcaaacttgaaattcagcgactgttaaattacctaaaagaatctaaggaaaaataaatgtcagaaattatctgggatttagcattaatccaaaagtataaccattcaggtccaagatatacctcctatccaaccgcacttgaattcaatgaaagctatactgataaagattttcagcaagctgctactcgttatcctacacgtccgctttctttatatgtacatattccattttgtcataaactttgttatttctgtgcgtgtaacaaaactattactcgccatcaacataaagtagagatttaccttgattatttagaaaaagaaattcaaacaagggctccgttatttcgtcatcgcatcgcaactcaaattcactggggaggcggtacaccgacttatctttcagaacaacaatctgcacgtttaatgcaaatgctggaagagaattttactatttcagataaggcggaaatcagtatagaaatggatcctagagaaattgagctttctatgctggatcatttatacaaaattggttttaatcgtattagtatgggggtgcaagattttaataaagatgtgcaaaaagcagtgaatcgtgaacaagatgaagaatttgtgcgtgaattgttgattcgtgctcgtgagttaggttttcgctcaaccaatctcgatcttatttatgggttaccgttccaaaccgtagaaagttttatgtttaccctacataaagttatcgaactcaatccggatcgtttgagtgtatttaactatgctcacttaccaagccgtttcgccgggcaagcgaaaattaaggataaagacttaccaacacctgaaacaaaactaacaatcttgcaaaaaactatcgaaacgttaggacaagcaaactatcgttttattggcatggatcattttgctaaaccggatgatgaattggcaattgcacaacaaaaaggaattctacaccgcaatttccaaggttataccacgcaagaagaatgtgatttattaggtttaggtgtttctgccattagtttattgggcgatacctatgctcaaaaccaaaaagatctcaagcaatactatacccacgtagaagaaactggtttagcattacacaaaggtttggtgatgacgcaagaagactgcctacgtcgtgatgtgatcaaacaattaatttgcaattttaaattagattttcaaccgatagaacaacaataccaaattgatttcaaaacctattttgctgaagatttagctttgctccaacccttagcaactgacggcttagttgatattaatgacaatgcgttacaagtatctgctaaaggtcgtttgctcattagaaacatttgcttgtgttttgatacatactccagacaacaagcaaaaagacaacaattttctcgaattatttaacgaaaaagtgcggtcaaaattaaccgcacttttttaacctcgctgtgcatttttcataatgcgatctttcgttactttccattcacgatctttaatatcttcacgcttatcatgtaattttttcccttttgctaaacctattttcacctttgcccaaggacctttccaatataatgaaagtgcaacaatagtgaaaccatctcgatttgctttaccaaataatgaagccaactctttctggtttaataaaagtttacgtgttcttgtgggatcgcaaacaatatgcgttgaagcaacacttaacggctgaatggttgcaccaaataaatatgcctcgccatgcttaaaaataatataactatcgccaatactcgccttacctgcacgcatcgatttaacttcccagccttgcaaagaaagaccggcttcgatttcatcttcaataaaataatcgtgtcttgctcgtttatttaaggcaatcgtattagatgctacctttgcttttttctttgtcatataaattcatatctcattaaaaatttttcgcattttacccaatctaagcaaagatcgcaaaaaggcttgcattacatcgcattctctataacaatgcggatattcttgataacccgttacgcaaaatatgaaatataaaaatctacgagattttcttgaattattagagaaacaaggtgagctcaaaagaattacacaggaaatcgacccttatttagaaatgacagaaattgctgaccgcactttgcgtgccggtggtcccgcattactttttgaaaatccaaaaggctatgaaattcctgtgctttgtaatttatttggtactcccaaacgtgttgctcttggaatggggcaggaagatgttaccgcactgcgtgatgtagggagattactggcttttctaaaagaacctgaacaaccaaaaagttttaaagatttatggtcaagtcttcctcaatttaaacaagtgctaaatatgccaacgaaagttttgagtaaagcagagtgtcagcaaattgtattctctgatgctgaagttgatttatataaattacctattatgcactgttggaaagatgatgttgcacctttagttacatggggattaaccatcactaaaggaccaagtaaaaaaagacaaaatttaggtatttatcgccaacaattaataggaaaaaataaactcattatgcgttggctatctcaccgtggcggtgcgttggattttcaagaatggaaagaagcacgccctaatcaaccctttcctatttcagttgctttaggggcagatcctgccactattctaggtgcggtcacaccagttccggatactttatcggaatatgcttttgccggattattacgtggtaataaaacggaagtggtaaaatcaatcagtaatgatcttgaagtacctgcaagtgcggagattattttggaaggttatattgatccaacggagaccgcacttgaaggtccatacggagatcatacgggttattacaatgaacaagaatattttcctgtatttaccgtgacacatcttaccatgcgtaaagatcctatttatcattcaacttacacaggtcgtccaccggatgagcctgcagttttgggtgaagcactgaacgaggtttttattcccattttgcaaaagcagtttccggaaattgttgatttctatcttcctccggaaggatgctcttaccgtcttgcagttgttacaataaaaaaacaatatgcaggccacgctaagagagtcatgatgggagtatggtcatttttacgccagtttatgtacacaaaatttgtgattgtctgtgatgacgatataaatgcacgagattggaaagatgtgatttgggcaattacaacacgtagcgatcccgcccgagattgtacaattatagaaaatacgcctattgattatcttgattttgcctcaccgattgccggtctcggctcaaaaatgggaatagatgcgacaaacaaatggattggagaaacgcaacgtgaatggggaaccccaattaaaaaagcccctaatgtagttaaacgcattgatgatatttgggagagtctaaatatttttgctcccaaataaacagcaaaaggtaaataagtgcggtgcttatttacctgtttattttaaacgctcaaatccggctttaagatcggcaataaggtcatcaacgtcctctaaaccaatatgtaggcgaattaatgtaccggttaatttgcgttcaatattaggtctaatcctagcgatttcttccggttgattgcataaaatcagcgattcaaatcccccccacgaatatgccatagtaaaaatcttaaaatgatccataaaattttctaacgcctgttgagaaagttttttatttagttcaaaagaaaataatccgctggaacctgtaaaatattgcttaaaatattgatgtcctggacaacttggcaatgccggatgataaacagtttttacttcaggttgttccagtaaccatttagctactttaattccattttcttgatgctgttttaagcgaactagtagagtacgaataccacgggctgtcatgtaggcggtatcagcatcgaccatctgccccattaaataagaattttcacgtaattgttcccaacaacgtgcattagccaccgctgtaccaatcatcgcatcagaatgcccaatgagatattttgtcccagcctgaattgaaatatcaataccaaaatccaaagccttaaaaaatacacctgcactccaagtattatcgatcataactactattttaggatttatttggcgagcagcttgcacaatcgatacaatgtccggtatctccatagtaagtgaacttggtgcttccaaaaacaagactgtcgtatttggttgaactaaatccacaattttttcaccaattaaaggatcataaaatgtggttgtaattgacattttctttaaaattatatgacaaaattcttgcgttggttcataagcagcaccgctcattaacacatgatcaccggtttttacaaaagctaaaatagcattacttaccgccgccgcaccgcaaggatagagatagcaaccctcaccaccttccaattcacacattaattcttgcaaagcaaaatgtgtcaatgttcctcgacgtccataaaataatccaccttttgctcgattgatagttgcttgttttttatctgctaaagtatcaaaaaccaatgaagatgcacgctgaataacagggtttaccgcatttttacatactcgtttattacgccctgcatgaattgttgatgtggtaaaagaagttgtattactcatagaaatatccattttaaacaaaaatcaagattataataattgatttaatagtcaaaaactaatacaaaagtgcggtcttttttcataaaatagttgtgcgaatttgctttagaatgcaaaattcttaataacttttataggagatttttactatggtattagttactcgtcaagccccagattttaccgcagcggcagttttaggcaatggtgaaattgttgaaaaatttaatctaaaacagcatattgctgggaaagcggcagttgtttttttctatccaatggattttacttttgtatgcccatctgaattaattgcatttgatcatcgttataaagaattccaagatcgtaatgtggaaattattggtgtttcaattgattctgaatttacacacaatgcatggcgtaacacaccggtagataacggcggtattggtcaagtacaatatgctttagtggcagatattaagcacgaaatcgcaaaagcttatggcattgaacaycctgaggcaggtgttgcattacgtgcrtcattcttaattgacaaagaaggtgttgttcgtcaccaagtcgtaaatgatcttccattaggtcgtaatattgatgaaatgttacgtatggttgatgccttacaattccatgaagagcatggtgaagtatgtccggcacaatgggaaaaaggcaaagaaggtatgaccggtagcccagaaggtgttgcaaaatacttaaaacaaaatgcagataaactttgatctcatsaaktttaactaaaactasccccgyacttatgtggggctatttcattataaatctagtyattcttataagatcctctgaaaaatagaaataacattattagcaataattttccatgaggatatacaaaaaagctcccaaaataaattttaggagcttcaaattttatttcataaataattagcgacgtaagcctaaacgtgcaattatttctgaatatttagcaagatctgtacgttttagatagtctaaaagtttacgacgacgagagaccatgcgtaataaaccacgacgaccgtgatgatcttttttatgtgtagaaaaatgagcttgcaaatggttaatttgtgcagtcaataatgcaatttgtacttctgaagaaccggtatctttcgcatcacgaccaaattcagcaacaatagctgcttttttttctgtacttagagacataaacattccttatactaaaagggttgataatacatcattcgccgatctctaactcagcgatgacaggaactgcagattctatctctcgattataaaaaaagcaataaataattactcaacatacaaactagacctacttacaatgttactgcattatttatgcgtattatgcgtaaaaactaaaaacgatagatatatttttcttgattttatagcaagaaagacaaaaaatattagctaataggattataattaattaagatatttaattttagataagtggcataagtggctaaacatgttccacataaagtaggataaaaattttctcaatctattcaatcaaatttttggagatttatattatgacaatacaaccagatccaacttctgtaaaaactcactttcaaggcaatgacaaactattgtttggtatgattatgggagtgattgccttttggctttttgcacaaaccacgttaaatattgcacccgatatggagcaagatttaggtgttaacaccagtattatgaatattgctgtatcaattacagctttattttcggggatgtttattgtcgttatgggtggtcttgcagatcgtatcggctgtttaaaaattttaaatttaggttttttattgagtattattggtgcattgttaattgcactggctccatctggtgatttagctgtcccactattaatgttagggcgtattattcaagggatatctgctgcttgcattatgccatctagtttagctttagtaaaagcctattgggagggcgaagctcgtcagcgtgctattagtatgtggtctatcggctcttggggtggttctggtttatgtgcactcttcggtgggttagtatctcaaaatctaggttggcgttatattttctttgcttgtgccgctttatctttattaggttatgttatgtgtcgtggtaccccagaattcaaaatggaagatgatggaaaaaaacataaatttgactggggaggtgttgttacctttatgattgccatgatcgctttacaagtattggtgactcaaggtggtgatttcggctggacaagcatgaccactatcggtttattgctagtgacttttgtgtcaatcgtattatttttatggattgaggagcgtgctgataaagcgtttgtggacttttcactttttaaaaatgcgacttacaccggagcgactatttctaacttcttgctcaacggtgtagccggcatgttaattgtatcgttacaattagtacaattgggcggtaatatgactgcacaatctgccggattgcttactattggctatgcgattgcgattattgcttttattcgtgtgggggagaaattattacaacgttttggtgcccgtacacctatgatttggggctgcctaattacaggcttttctattgctttgttattaccaacgaatatgatgttggatcaatataagattatcgttgttatttcttatatcttgtttggtataggtttagcattttatgcaaccccatccactgatgccgcattatcaaatcttccgcctgaacaagcgggggcgggttccggtctctataaaatggcttcttcacttggtgcggcatttggtgttgctatttcagcggcaattttcaccgcactccgtgcagagaatgccagtgtatcttggttaaataacatcgtcccttttgttggtcgccaagataatattgctattcgtgaagctgctactattgcattaatgtttaacttattgatgatttttggggctattgtgtctattatgttgactgtgccaacgggcaaaaaatcatcctaaccacagtatttacttgatattcaggctacctaaatcattccggtagtctgaaaccctaaaaaacagggttcagtaaagaaaaaatcatgactatattatttacaaactatcaccccaagcaaatcggaaaaatcaacgtatattttccttatatctaccagccactatatatttagtcaaaaaaatctacgtctaaatttattggcggtttagtccaatttttgggtatagatcattttgaccgttctttttattttttgcataatagctactttatttttatccgtctcttacgtatggagcattctatgctgacagaacaatctaaaaaacataccgcacttttgtcttttttacctgtattactcttaattgctattgatttctttaccatgagtttacaagctcaagcaaaagcaatttcccacttgagtttagctgtattagttacacaattattatgtattttagtgtttgccaaaggtgaaatttgcaatggtcaacgtttcagattagtaaaggtaaacttatattttttgatttattgggggttatggctgtttatcagtttattttccaattatcactatgtattaactgatattgtatgtttgtgtggcattgctttaactttggctatttggcaacaacctcaagatttgcaaatgcgtaagtcattgttggttttaggaacacttgtgggagttttaggtatagtaacttattgtttaatgtttattgatttacctttactttatttttctcaatataatccagtagctcaagcattgctaggcatcatattagcgaatttattgctagtcatcgctaaaaatcgtttacaaggctttattatcttattgccttttttgatgctgattactttattactgaatgcaattattgtgttaggtattttgttttttgctatatcacaacaagttgtattttctaatgagttttcttggggactttattttattttacatttacttgttactggcattattgctatacatttattttataaatggaagtttgaatattacgttctgttaataatgagttttattgcgatgagttttcctttgtgggtaagttttgcctatgtgttttaactaaaataactgcctactttttggaaatgattgatcattgatgagtatgtatgttatcagataagagaaaagcggacaaaatgttttattttgtccgctttgtgtaatattgagaggactaaatgttaagtacagcaattaaagctaaaatagagtaaagtactgataatccgtagaaaataatcccacctgctggaatatgaagtttaaaatcatgtgtgccatggtgaattcgatgcattgccccccaagttggaaaaactaatacaactaatagaatcagtttacctaaccaagaaccggcaaaagcaataatattgtctgcaccgttttcgattaatccaaaaggtagtaatagacctaggataaaaatcaatatagggaagacaattgcacttactgtagtacctgcaccgaacaataaccatacaacaggttcgttagagcgttttggagtttctttcatcttggtctccctatttcaagtaaattagcactaaagcaagaatacttactacggctgtaacagcccacataccgatagtaataacattcggatttagtttttcatttttgtacacgatatttagcacttttggcgtcatgaagaaatacgtaactgtattcaaaatggctgctgccaaggcgataatattcagaataataacaattggattttgtaagaaaggaataaaatccgattgcaatccatctttttgacctaggcagatcacgccataaagtaataccaagctaaaccataatgatggaattgctgttgcttcacgcataatgtaaagtttgtaaaaatctagctttttccaccaagttgcttttacttcccgcacatatcttctgcgtttacttgttactgttgtcattttacactccttacttttgcggttttaacattgcaatgacgaaatcttttgcactttcgactttaccttggttgacaccagaagcaggatctacatgtttagggcaaacttcggaacaataacccacaaaagtacaactccatacgccatttttaccgttaataattttcatccgttctgcttttccgtgatcacgattatcaagattataacggtgagcaagagttaagactgccggaccgacaaattcgggatttaagccaaattgcggacaagcggcgtaacataatccacagttaatacacatagagaattgacgatatttctctaattgagccggcgtttgtttagtacgactttccgccaattccgctgacgtatgtggtttaccatctaattcaggtgctttattgcctataatatatggtttgatactctccaaactttcaatgaagtgactaaggtcgaccactaaatcccgttcaatcgggaagtttgctaatggttcaatacgcatatgaccactataatcacgtaaaaaagttttgcaggcaagtttaggtttaccgttcaccatcattccgcaagaaccgcagattgccatacggcaagaccatcgataagaaagttccggttctaatttatccttaatataacctaaagcatctagtaaagatgtttgactgtcataaggaacttggtaagtacgtaagtatggctctttatccgcctcaggattataacgcaatacttcaatattcattattgcttgattagccatttgcttgctccttagcttttgcagccgcttcttgtgcttcagcttccgcaccgtaaacacgttttgctggttgagatttggtgattttcacatcgctgtattcaatccgtggggcaccatcagcattataatatgctaaagtgtgttttagataattcacatcatcacgctcagtatagtctaaacgttggtgagctccacgagattctttacgttcaatcgcagaattagcaatagattgagcaacatcgagaatataacctaattcaacggtatagagaacgttggtgttaaatacgcttgaacggtctgcaatacggatatgtttataacgctcttttaattctgcgattttatccacggtttgttgcatactttcttgtgtacgataaatgccgcaaccttcttccattgaatcgcccatttcatcacgaatttgcgaccaagactctgttccttcttgattgtataactcttctaaacgatggataacatcttgagcttgagcatcgaccgcacttcggttagcaggttgtgcttcaattgcacgctgtgctgcatattcacctgcaacacgtcctagcaccactaattctgctaatgaatttgaacctaaacggtttgcaccatgtaaaccagaagacgcacattcaccaacggcaaataaacctttaatacgggtttcgctattgaagtccacttcaataccacccatggtgtagtgtacgacaggacgaacgggaattggtgctttggcaggatcaacaccttcgtaagcattggctaattcacagataaacggtagtcgttcatgtaaatatttttcccctaaatggcgaagatcaaggtgaacaacatcaacaccttttgctgtttttaacgtattgcctttacgccattcttgccagaaggcttgggaaactttatcacgaggacccaattccatgtatttattttccggttttccgataggtgtttccggtccgagaccataatcttgtaaatagcgatagccatctttattcaccaaaataccgccttccccacggcaaccttcagtcattaagatacctgtattcggtaagcctgtcggatgatattgaacaaattccatatcacgtaacggtacaccatgacgatatgccatcgacaagccatctcccgtaacaatacccccgtttgtgttgaaacggaatgcacgacaaccgcctcccgttgcaataatgaccgcattagcattgatttgtactagagtaccttccatcatattcatcgcaaccataccacgagcatgaccgtcatcaactaaaatatctaatacgaaatgttcatcaaaacgctgaatttgtgggtactgaatggaagtttggaagagagtgtgtaacaaatggaaaccggttttatcagcagcaaaccaagtacgttcaattttcataccgccgaaacgacgaacgtttacatcaccatcaacttttctgctccaaggacagccccaacgttctaattgagtcatttctaccggagagtgttgaacaaaatattccaccacatcctgttcacacaaccagtcaccaccggcaacagtgtcatggaagtgtttatcgtaagagtcctcatccttaattactgcagctgccccaccttctgcagcaacagtatggctacgcatcggatatacttttgaaactaaagcgatctttaaattaggatttgcttccgctgctgcaattgccgaacgtaaaccaccaccaccggcaccaacaattgcgatatcgacattaactgtttgcacgatattcctccaataatagataagagtaaaaattaatccctaacgggaaattacaaaagcaatactattctgccactattttaaaagagatataactcttttttgttaatttaagctagaaaattttaatttcgtgatctaactcaaaactatatttgaaatagataagaaatattctcattagtttaaaattagatgataagcaatatcatttattaacaaaaacatagcgttactattataaaaattgatttgtcgcattattatttttttcaggtagaatatttcaaaaaatttataaaggattttattatgtctttgaatgaacaatggcaacctagtgcctcgatccaaaatttattggcaagagcaaaaattattgcggatattcgtcgtttttttacagagcggggattgttggaagtggaaactcccgtattgagtgaatttggcgtaacagatgttcatctttcgactttcagcacagcctttacatctccgtttatggaaaagtcaaaaactttgtggctaacgacaagccctgaatatcatatgaaacgtttattggcagctggaagcggtgcaattttccaattgtgtaaagtatttcgcaatgaagaaagcggcaaaaagcataatccagaatttacaatgcttgagtggtatcgaccgcactttgatatgcatcgtttaattaatgaggttgatgatttgttacaacaaactcttgattgtgaaccggctgagatggcgagttatcaatttgtatttcaggaacatgtaggtatagatccgttgtctgcaccgattaatgaattgattgaaaaagcaagagaatgccatttggacggtgctgaaaatgaggatcgcgatacgttgttacaatttttatttagcacgcttgtcgaacctaatattggccaaaataaacctattgcagtttatcattttccggcaactcaggcggcccttgcgcaaattagttcagaagaccatcgtgttgcggaacggtttgagttttattataagggaattgaattggctaacggttttaatgaattgactgatgcacaagagcaagaacatcgctttaatcaagataatcgcttaagagaacaattggggttaccacaacatgagattgatcatcgttttttaggtgcattacaagcggggttgccaaatacagctggggtggcattgggagttgatagactcattatgcttgctttaggtgctgaaaatatcagcgaggtgatttcgtttaatatagattgtgcttagaataaagtttttgtatcacattgcgaaaaagaatttttacaaataacggtaaattattctttcaaactaatttgatgtgaacccaaagattgtttacgattaatcattgcatgaactactaattgtgcagttttaatagcatgataaatttcaatactgtgaatctttttgagatcaataggacaatttttttccaaatgttgtagttgtgtaattaaacattgcaaattttttttagttctatacacattggcaaattgattcattaatgatcttacttgtcgcaatatttcacttgatgagtgagcggattttttctcttgattggctaaatgttgtaaatagcgtattccctttaacacataatgttctttattttgtgtagaaaagtgcggtacattttccacaactttttgtatcgctcttttggcaaacacgaggctaccgcctacagagttccctcctagacgatttgctccttcaatacatgcagaaacttcccctaccgcaaataacccctgtactgctgtttgggcgtattcattgatttcaattccaccgttgcaactatgagcaaaaggtcgaattattacctgatctcgcaataaatgaatatccatttctttttccagccaagttaaatagacttgataaaattccgttttatcatggtaaagttcgggagaataatgtagatacactcctttctcagtaggattttcaatcaaatgtttcattattacgagatcaaattcaacactttgaaaatccacactaaaaggtgcatagctactacgttgtcgtatcatttgctgaaattgttgcggtgataaatgagaaaataaattcttacctttgctatcagtaacctttatcagatattttaaagtatgctcaccgaacaatactttatacttaggtttaacaaaagcaggaatgaattgaataaattcaagattggttaattttgcacctgcttgataagctacatagtgggtcgaacctattatatctgcaggatagagattgtcttgatacaaccccgcaataccgcctgtggctaatatgatattattcgtgtagcaaaaaatatagcgaatctcaccgcccttttgttgaacaaaaatagcacctttaatttgattttgttcagtaacaatatgtaataaaacagagttttcataaaattctatttggtgctgaattaaaatttgtttagcccgtttagcactttgtttccagttattaattaaatagatcgggcgagtatagtatgcaaagcaagcagggcggttatcttgtcgtagccaaggagtaaatccaattttactcaatagctcaatagcttgtggtgattcttccacataagccctaacaatcttaggattatttactccacaagcgactctctcaatttcttgttgaaagagaattttgtcatcggaatcccctgttatttgaataccaagtgtcgcttttagcggaaaaaaacttgcacctccacctattattgatttgctaattaaaatcggattaagtccttttgcttttgcctcaacacagcatgctaaccctgcaataccagctccaacaatcaataattccgtttcaatttggtggtgaaatttaatatttgtcataatctataaatcttttattaaagataaattcaatgcccacatcacaaaaatatcagcaatatcttccgcttaattaactactacaataatgatggtgctgcattgagcaaaattttggtatattcctgttgcggattattaaaaacatccattgcatcaccttgttctacaatcaagcctccattcatcaccacaatacgatcagatacttgacgaacagtttgtaaatcatgagagataaacaccattgcgagatttaactcttttttaagatcggcaagtaaatttaacacttgagcccgtacagacacatcaagggcagaagtaggttcatccgctacgattaactttgggtttaatgccaatgcacgagcaatagcaactcgttgtttttgtccacccgacagtcgtgtaggttcaaccaatgctgcagagcgaggtaatcccactcggaaaagaagttcatacacccgtttttcacgttcatgggggtgcagtacattatggatattcattggatcttttaatatatctattactcgcattcttggattaagtgcggtggcaggatcttgaaaaatcactgaaacttgtcgtccgaattgtttgcgagcctctgcacttccgtatttcatctttaaaccgttaaattttactgtgccggaagagggtttttgtaaaccaatcataacattggcaagcgttgatttaccgcaacctgattgtcccactaaacccaaagtttctcctgcctgaatatttaggctaataccatctatagcagtaaattttttcggattaaatattgaaccatcacgggaaggaaattgcaccacaatatcttgtaattcaatgattggttgtttttttaacactttcatactcatgttttaattctccaaatgcgatgcccataaatgtttcggattatcttctgcttgtactaatttcaaatgttgatttggatttgcattaggacgaagagaacgactggcaaatcgatctccttcagcaaaatcaaaaggcgatggtacactgccaggaatttgatacaagcgttccgctctacactcagtagaaagtactgaacccagcaaccctctagtgtattcatgcatcggattcattaataatgaacttgttggagcgacttctactacctgtcctgcatacattactgtaatatgatgagcgatttgtgctactaaggctaaatcatggctaacaaaaaccatagcaaagcccaatttttctcgtaattcattaagtaatttaattacttctgcctgcactgttacatcaagtgcggtagtaggttcatcagcaatcaataatttcggttctctagccaatgccattgcaattaatactcgttgacgttgtccgcccgataattcgtggggatagcgatttaacgttttttcaggctctaatttaacccatcgtaaaagtgtttccgcactttgttttccgccacgctgaatcagttgtgccatttgatctttaattcgcattgatgggtttaacgcacttaaagcatcttgataaatcatagaaatttcgtgaccacgtaaatcatttaatttatctgttttcaataaatcatgttgatttcctgcacgatctgtaaaaagtatttctcctgtaatcttggctgttttaggcaataatcccataatggaaaatgcagaaattgatttaccacagcctgactcgcctaccagccccatagtttcaccttcatgaacagtaaaactaatattatccactagtggaatatcaccataacgatttggaaaacgaatagataaattctttacttgcaaaattggcttcattgctgaattaagttgcattctatcagtacgttccgattctttttgatttaattttaataaataacgtttaagtgctaaactttccgccatagcttcttgtacatcggtagcaagaggctttgatacatcacctttgttatttggattacgtttaagttttggattcacgagagcatcagttagtccttctgacaaaatattaagtgataaaacggtcaacaaaatcattaatccagcaaaggtagtggcccaccaaaagccacttaatactaaatttcgaccttcggataaaacatttccccaagatggataagggggttgtactccggctcctaagaaggaaagagaagcttccaatacaattgcatctgctaccatcactgtagcaaaaaccaaaacaggggcggcagtattgcgaactacatgctttaataaaatatagcttctactgccaccaattactcgctccgctctaatataatcttcttcccactgagaaactacattagctcgtacaacccttgctaactgtggcgtataaactaccgcgatagttaaaataataatcggaacagagttaccaaaagtagccaataataccgcagctaatgcaattcccggaaatgccattaaaatatccattagacgcatgatgacttcattaccaaatttactcgctgtagcagcggttgcacctagtatgctaccaaaaattattgcaaaacctaccgcacctaagccaataaacaatgatgttcttgcaccaaacactaaacgagagaaaatatctcgtcctagacgatctgtgccaaaccaatagtcactatttggtgcttgcaccggtcgtaaggtttgtaatggatcataaggagaaacccaaggtgcaaaaatagcaattaatgcaatcaacatgataaacattaaagcaattttagaggccattgataacgctttgaatcttgctccgccttgagcaagtctttcggctaatccttgacgaaacatcataaactccgaatttttggattgatcacaaggtacaatacatcaacgataatattgaccaatacaaaactaaaggcgattgttagtacaacaccttgtactaaatgcaaatcatgattgacgataccgttaaaaattaattttcccatacctggcaggtcaaaaatttgctcaataactaccgcacctcccagcaaataaccaattcttaaccccaatacagtaacgggggtaatcaacgcatttcgtaatacattatgacgaataacggttgcataaggaacgccattaccaatggctgttcgcacataatctttatccatttcttccaccatcgtagttcgtacaacccgaattagagatgcacacacaggtacagctaaagcgagtgaaggcaaaatcatcgaataaaaataaccgctcggatcttcactaaaagaagtaaatccgccggaaggtaaccaatccagttccagtgcaaaatattgaattaacaaaatcccaagccaaaaagaaggtgttgctacagccgctactgataataaacgaataatttgatcaatccatgtatctcgataaagtgcggcaataacgcctaaggtaaaagaaactattgcagcgaggaatacaccaataaaagttagctgtaaagttagtggaaaggctttcgcaatcaaagaagtaatcggttgttcaggtggtgtggtcataccgaaatttaagtgaattaaatttccgataaaacgaaaatattgcacaattacgggatcatttaaaccgtgctgttctcgataaagttgctttgcagcctcacttgcaccttcccctaatgcgacagtggcaggatcacccggtgtaaattgtaagataataaaaaccaaagcactcacacctaatatcattatgggtaatgccgctaaacgacgaagtaataagcgaaagacaatttccattatttttctccaactatacaaaccaagtcagtagaatgaatctgctatcaataaagataggggctgttaatcataaccacatataaatgaccgcactttctgctcattaaaaacaagcagaaagtgagaaaagttaattatttgcgacctacaccaataaatgaaagtccggtagttggaattggttggaaaccatccagtgatttgttattccaagcggttggtaatttacggtgcaaaattggataaagcggtacttgttcagcaataagattaatagcctgagtccaagccgcttttgcatctgatggctgttttgctttaattgcatcatcaagtaataattgcaatttcgcatattcaggggtatctgaccaaccgaagcgttttttcggccaaacatcaccacgataccaccagctcaataagagatccaaatcgttgctaaatactgatggatcccccggtgccattacgacttcataatttcctttgtctacgtaaccaccatacaatgctccagattgtagatgctgtaaagttactttcacacccggaattttattccaagattctaaaactaaaggggcacattcttttatccaagaatgatctgtagaaagcaattgaaactctaatttattcagacctgcttcttttaaaagtgcggtggctttttcaggattataatcatactgggttgaagccttgacataatcaggatgcgtatcttgagtgtaagaagtggcagcttttgcattacctaagaatacaatatcaattaatttttgtgtatccagtgcatagtgtaaagcttgacgtactttgggattgttaaatggggctttcttacaattaaacattaagaataataacccgaaagattgcacggattcaaccgcacttttacgttttaagcgagatgcgtctaaataaggaacactttccattgcttgagtacgtccagactcttgtgccgctgtgcgagcggcatcatcggatagtaaaaaccatgtcattttttctacacgagcaggatatggaccgttgtaagcattgtgtgcggcaaatacaatgcgatcgtcttttacggctgaaacaaatttatatggtccggatcctaccggatttgcatcaaatgccgtttgtcctacagcctcaatcacatgtttaggtacaatttttacaatacctaatcgcaatttaaaaagagaaaacgggtacttcaacttaaattctaccactttatcatctaaagcgttgactgaatcaataaacggaatgaattgtataaatagtgaagcattttttggatctaaaatacgctgataagaatatactatatcctctgtggtaacaggtgtaccatcgtggaaagtcgcaccgtcacgtaatgtaacacgccatgttatatcatcaacttgttcaggttcttttgcagctaaggcgagataaggttcacgggtggcagggtgtaaatccactaatccttcaaaaaagtgcatgttggcggcaaaggaagaggctccactggaagtggacggatcaaaaccggttgataggggataagctattcctgcttcaatgctactacctgttgttgaagtggccttcgccttagaaacaaaactacctaatgtaccgctaaaggcaattcctgcaccgacaccagccaatactttcatgaaattacggcgagattcattttcaatgtaatttgtcatacatgctccttaaaagtctattttgtacacacttattgagattaatacaacgttccttacacttacacagaatatcattccctaaaatgaagtaaattaatcacaatataaattaaaatgaattggattaatcataatcgtttagagcaaacagtcaagaacatatgtaaagtaaaatctatgtttgtgaactaggtcacgaaataacggaaatctcaatttgattaaagagttaactactatctaaaagcccctgtcagctatagggaaacttgatgaatataaagtggctaattagccactttatatttgcatctgatatttaaacaaatgttttaaagatgacattatccgctttctgaatataactattcatttgatcaaaattcatatagcgataggtatcgtctttatcttgttgcaaattttgaacaaaatctaaatattcagatggggtaggtaatttacctaacaatgcagaaacggctgataattctgccgaggcgagatacacatttgctccttgtcctaaacgatttgggaagtttctagttgatgttgaaactaccgtcgcaccatcggcaacacgagcttggtttcccatacaaagagaacaacccggtacttcaattcttaccccacttttaccataaatgctgtaataaccttcgtcactaagcaacttagcatccattttagtagggggagcaagccatagccttgttggaattgtaccgttaaagcgagctaataatttacctgctgcacggaaatgaccaatattcgtcatgcaagaaccgatgaatacttcatcaattttgtcgccctgaacttcagaaagtaaacgagcatcatcaggatcattcggggcacataaaataggctccttgatttcattgagatcaatttcaataacagccgcatattcggcatctttatccgcctctaatagttgaggattcattaaccaattttccattgctcgaatacggcgttcaagggtacggacgtcaccatagccttcggcaatcatatatttaagtagaacaatattagattgtaaatattcgataataggttctttagcaagtttaatcgtacaagcagctgcggagcgttcagcagaggcatcggacagttcaaatgcttgctctacctttaattgctccaagccttcgatttctaaaatacggcctgaaaaaatgttctttttacctttcttttctacggtaagcaatccttgtttaatcgcataataaggaatggcatgaaccaagtctcgtaatgtaatccctgcttgcatttcacctttaaaacgcactaaaacgctttcaggcatatccaaaggcattactccggttgccgccgcaaaagcgaccagtccggaacctgccgggaaagagataccgattggaaaacgggtatgagaatctccgccggttcctactgtgtcaggtaataacatacgatttaaccatgaatgaataacaccatcgccaggacgtaaagatacgcctcctcgattcataataaaatcgggtaaggtatgatgagtaaccacatcaacaggttttggataggcggcagtatgacagaaagattgcatcactaaatcagccgaaaaacctaaacaagccaaatctttaagctcatctcgggtcataggtcctgtagtatcctgtgagccaacggaagtcattcgaggttcacaatattgtccgggacgaataccctctacaccgcaagctcgccccaccattttttgtgccaaagtgaaacctttttgattttgcaccgcactttgtggtttggcaaaaacatcgctttcaggcaatcctaatgcaactcttgctttgtgagttaagcctcgcccgataatcaatggaatacgtccaccggcacgaacttcgtctaataacacattagtttttaagctaaattcagctaaaatatcattactgtcatgacgacaaattttgccttcataaggataaacatcgatgacatcgcccatatttaaacggctgacatctacttcaattggcaatgatccggcatcttctagcgtattaaagaaaataggtgcaatttttccccctaacaccacaccgccggcacgtttattcggaatataaggaatatcttcccccataaaccataaaactgagttagtcgcagatttacgtgaagacccagttcccacaacatcgcctacataaaccaacggaaagcctttttgtttcagtgtttctaattgtttgattggaccaatattaccattatcatccggtttaataccttctcgggcattttttaacatagcaagagcatgtaatggaatatcaggacgagaccaagcgtcttgtgctggcgaaagatcatcagtattagtttcaccgctcaccttaaatacggttaaggttaatttttctgcaagttgagggcgagataaaaaccattcagcattagcccaagattgcaaaatctgttgtgcaaaaacgttaccgttttctgctcgttgtgcgacatcatgaaaattatcaaacatcagcaaagtagaagacaacgctttcactgctataggtgctaattcaggattatcaagtgcggtcaataatggctcaatattgtaaccaccttgcatagttcccaaaatttctactgctttgcttggtgaaattaatttacaagttaccgcactttgtgccagtgcggctaaaaaaccggctttaacataagcagcttcatcaacaccggcaggaatacgattctcaaataaatcaagtaggaaatcctcttttcctgtcgggggatttttcaataattcaattaattgagctgtttgctctgcatctaaaggtttagggacgacgccttgtttagctcgttcatcgacatgtttttggtaagtttgtaggaaatcgcacattattcactccattaagattgttgagtagagaaaagagaaagtgcggtcatttttgttaaaaaattgtaatacaaatagaccgaattcatcataatacggaatttatagatgaacaatagaaaaaagacgattattaaaaaataaccgccttttttaaagtagaacacaaaatgtttaaaagacttttttaaatggtttaatgatgactttatcatatacaccggctgcaacataaggatctgtatttgcccattgctccgcttcttctaagctattgaattttgcaataacagttgaaccggtaaaacctgcttctccaggattttcatcatctatagcaggattaggtcccgcagttaataacctatcttcagcttgtaattgttttaaacgttcaaggtgttgttctctgacggataagcgtaatgctaatgtatcaggtttatcttgagcaaaaataacatagtacatcatggtttatttctcctatttattatgagttatttgctgaaatttgtgccaatgctttttctacttccggattattgtctcttggtatggctcgaggtttaccttgtgcatctacggcaacaaaagtgaaaacagcttccgttacacaatagcgttcaccaataggttcgctggcaacctttttgacccatacttcaattttgatttgaacggaagagcggccaatttttacacattccccataacagcaaaccacatcgccgacagcaataggtttgataaatgtcatactgtttacagctactgttacaacacgtccatgagcaatttctttagctaaaatggcacctcctatatccatttttgacataatccaaccgccgaaaatatcgccattcgcattcgtatttgaaggcatagctaaggtacgtaataagagaactcccttcgattgacgacctgtattagtttcaataaatactgacatagattttccttattcttgttctgatttaggtaaataacgataaatataaacaccggttactaatgttgcaatcagtgtcatgccgagaatgccgaaggttttaaaatccacccagatgtcatcagaaagatactggcttatgtaaagattaatcagcatacaaagtaagaaaaagactgcccaacctaaattgaggttatgccaaacataagtgggaagctgaatttctttgcctaataattgttggattaaaggttttttaaaaccatattggctgacaagcaaaatcaaggaaaaaagggcataaacaacggtaaccttccattttaaaaattccaattcattaaaataggcacttagagaaccgaaaaaaactaccgcacttcccataataagttgctgtttctcaatttttccatatttaagttttaaaatcatgagttgaattaacgttgcaataatcagcgtaatggcagcagcttgaataccttgtaatttgtaaacagcaaagaataagatcaatgggataaattctaatagttgtttcattattgtcccctttgttgcataaagagagtgtaaaaacggtaagtgaaaattaatagaaatacgtctgcaagggaaattattgcagtgattaagatttccataaacagattatgactgagaaatagcgaaagctgtcttaataaaaaaggcaataggcaattgattaaagtatataagaataacaggtgtgtgcgttttactccgcttttccacattgtttttaaactttgactaatggagtgattatgtatgaggtaatggacattgagtaaattaagacgcacaaacacaaatatacctaatgcgagtgcaaataaagaaaagatagaaggtgatttgtgcatgagagctgaaactagaatttcacttgtaccgatacccaaaggaatagctattaatatattgagtaacaaaagccctccgaaacgtttagttgtcgatataacgctttgagatagttgcggttcgatatgttgactgagttggtgaatggttaatattccccaagcagaaataaacattctcaataaacccgatatgaacaggtaatgactgagttgcaaagtttccgtatttgatattgtttctgatagctcaagcgtgtctgtttgtattgactgtttaaaaaataaagcaaatacagaaacaataaataaaagagcggtaaattgtagcgtgattttttgttgattgcgtacaaagttccaacaatcttgaaatatatgagtaaaattaatcattcaaaaatccataaataaaagcaaacgttacgcattatactgtgtttacagccgaaagtataaaaatccttattacagaccttaagcatactaaagaggagatttaaacttttagtaagctgattgtaacgattttaaaaaaatttttaacaaaattttataaatttgatctagttcacggaaataatacctcttaagtggtattgtacccgccgattgcataaatcggcaatttttattgtgagcaaatattctaatagatgaggaattttctatgaaaaaaacagcattagtacttagcgtggcggctgcattggtggcaggaagtgcaacagcacatgaagcaggcagttttattgttcggggtggtcctattttagttgtgccgaaaacatcaacaaatgatgatrtgtttaagtttgatgtaaacaaaaatgcccaattggggttgaccggaacctatatgatgacagataacttcggggttgagttattagccgcaacaccgtttcatcataaaatcacgttagaattacattaggtagtgccttagtaggtaaaacaaaacatttaccgccaagcctatatttacaatattatttcttaaacaaagattctaaagcacgtccttatattggtgccggtgtgaactatactaaattctttggtgaaaaagcgataatggagggtgtttccaatcttaaattaaaagattcttggggagcagtatttaacgcaggggtagatattcaattgtccgataatctttatttaaataccgctgtttggtatgcgaaaattaaaacaaaagcaagttttaaaatgaatggtgctgttcaacaacctcaacagaataaagtcgatgtaacccttgacccaatggtatttttcatcggtttaggttggaaattctaagcagagaaaaatattgttgaaggcatgaccaaaaggtgatgcctttatttttttctcaaaatgaccgcacttttatggaaatagcgtataaagtaaaaattaatgttttctctttacatgattttcgttaaaattcggcattcgtccatttttagttattacaacaataatgatcaagcaagctcaattttatattctttctcaacaacaaggaaaaaacggactttttgcggaagaaagtcttacttgcgatcttgccgcctccgcttggcggttggggaaaaaagtattaattacttgtgaaacggaagagcaggcattaaaacttgatgaagctttatggcaaagagatcctgatgaatttgtaccgcataatttatccggtgaaatgacttcatacgtaacgccgatagagatttcttggcaagggaaacgtaatacacaacgacgggatatactgattaatctgcaatctcaattacctgattttattatgagttttaatcagctaattgattttgtgccggttgatgagcagttaaaaattcttgcgagagaacgctataaatcgcttcgttcgcaaggttggcaattacaaacagaaaatatgtaaatttttataaggagtttttttatgaaatctaaaattttggctaccacactcgttggattgctattcggattggttgcttgtgaaaaatcacaagaaagcgtatcaaccgaaaaactggataacaagcagacggagcaagttgaacaaaaacaactggaaagtgcggtggaaaacagcactgaaacacctgtgcaacatgttcaaactgataagatgtcagaaggaatgaaatcaacaaccgaagaagctagcactgattcagcaataaaccaagaaaaattagctgaaaataaagctaaacaggttgaagctaaaaaagtagcggaaaaaaatgaaaccaaaaaagttattgcgattttagaaaaacaataccaaagccttcattgcaccgatggaaataaaagcgaattttgtgtagaagaagcacaacgcttaaaaagtgaaattgaacgactaaaatctcaattgcgtaaatagaaagatgagtagtcgttagatttaagacatctacgctagataatctcttctctctaggcggtaagttagaaaaataacaagccgtagaatggctaatttatgcccagcttcacacggtttctatggggaaagagcggttagattttcgggaaattttgcaaaaatgaatcgtaaattaatccaaatcgatcagctaaaaaatcagcttacacaatatcgtccgctttctgaatccgaagtaaagcgtctgcgagaagaatttattattgaaagctcatataattccaatgcgattgaaggcaataccattaccctgcgtgaaacagtgctgattttaaaagagggaatgacgattgcggaaaagccattacgagaacatttggatattatcggtttcaaagatgcctttaactatatttatgaattagttgccaataatgaaccattaagcgagcgaaccattaaagatattcattcgcttgttttaatgaataatgccgaaagccgaggcgtttatcgtaaaattccggtgcgtattttaggggcggaaaacgaaccgacagctccttatttaattgctgaagaaatgcagtcattgattgaaaaatatcaacaaaaactgaccgcactttaccccatagaagcaattagttggttgcatttagcctttgaaagtattcacccgtttattgacggcaacggacgaacagggcgattactgattaattttgaattattgaaacacggctatttgcctgttgatattaaatttactcatcgagcaaactattaccaatgttttgatgatttccataaaaaccagcaggatattagcagtttggttgagttgattagtcagtatgaagtggctgagttgaacaggtatttggcgattttggagcataggacataaaatgacaagccgtgaagaattactcaaaaaacaacgtgagctggatattctttttaccgcttggtttgaagaaaagaaaaagtacgaagtgctgacttatcgtcgtgaaaatggggatttgattcagcattatccggacggtacagagaaagtgatcaaatatgctgaaaaaactagcactgctcgtatggcgtaacaagcggttggatttaggcaaaattttgcaatgctttaatcggagggaattgtgatgactaaaccggtaaatgcggaatatatcaaagaaattattgataaaacgaataatcttggctatttggacatccaaggaaaaaccttgcaagaaaaacaagagagttttaaatctttaattcaggaaaaattaaagggatatcacaatgacagtcgaaaagatcattatcaccgaagctaaggttcacgagctttttgttgaaatcagtcaagaattggggtttagtgatgaagatattttacatcattctcaaaacattcttgaattgattgaaatgtggtcagagcaaaaatttgtcgaaatttatcaagaaaatacggatagagtttttggtcgggcaaaagatagtagtcttgcaccaggtgcggttccctattatttaggtatttatcacgccagagtagataaacaaggtgaaaatgatccgttaatcgttttaacatttagatcagaaagagaagataacatcgctgaaattcgctttatggcaacacacgatattttatttggcactgtttccgataaattatttatgcaacgaatgaaagctattcgtcaaagaattgatcttttagtccaaaaagggaattaatttataagggctacacggctacgcatcagcccacacggctcgtgtggggtgacaagcggttaggtttaagaaaaattttgcaaaaaacttctcaaaacagaccgcttgtaaaataacaaggcatttgtctagagaggagtaccatctggaaaataatcaaatatgcagataaaaaataacttaaagtttatggacttctgctcaggtattggcggaggtcgtttagggctagaactaaacggaatggaatgtattgctcacagtgaacttgatcctaaccctgatttaacttatcagctcttttttaatgataaaaataattatggggatttaaccaaaataaatatcaacgatttacctgaatttgatgtaatgcttgcaggtttcccttgccaaactttttcaattgtaggaaaacgcaagggttttgaagatgagcgtggacagattatttatggattagtcgatattttagccgttaaaaagattccttatttcattttggaaaatgtaaaagggttggttaatcataataaaggagaaaccataaactctattgttaagctgctagaagaaacgggctatgatgtttattatcaggtattagatagtcaattttatggtgtaccacaaatgcgtgagagggtttattttgtgggtattagaaaagatattaaacacaaaccttatcaatttcctgaaatggaagatgccaaacctatttcttattatttaagtgatgaccgtgattatacctttgatgagaacaatgaaactttccagaagtatttgaataataaatataatcaagggcaaaataaccttactgaaattttgcaaacggattataacgtgattgattggcggcaatctgatttccgactttatcctgaaaaaagcccgacattgagaaccggacgacacggtattttatataccaaaaatggtaaattgagaaaattaagtggttatgaagcattactattacagggatttccaaaagaaattgcacaaaaagttatcgagcataaattacctgacagtaaagttttatcccaagctggaaatgcaatgacggtgacggttattcagaaattagcggctcaattattaaaatcgatagaaagcatatagagaggtgaagatggatttagccaacctaggctcacaaactgcaaaaaatggctttaagaatgaaaaagatattgctgatcgttttaatcattggcaatcacattctgaagctcaagactggttaagaataatgggttatgaattagataaaattgaaaaggttaaagctgttgtattaagtggttataaagcagatattaatgttcaagtatttatcttttttaaagaagctgttgatgttcgtaacattcaagtaaaattagttagtaataaacgaggctttaatcaaatagataaacgctggttaaaaaattatcatgagatgtggcaattcccagcagaaatttaccgcttgttacagcatttttgtggagaactacccccggttattgagaacccaaaagataagcgaagaatgtttatcacagaatttagtgaacaagaacaacgtttaattttagattggttcaagcagagtaaaattttagttttaactgatattattcgtggtcgaggagatttttcagcagaatgggtattagttgcccaaaaaattaacgataacgctcgttggattttgaaaaatattaatgaggttctacaacattatggtagtggcgaaattaagatttctcgacaaggttcaattaaatttggtcgggttactattcaacgtaaaggtggagatcgtggcagacaaacagccaatatgttgcaatttaaaatagatccaaccgaattatttgagatttgatttcaagctgcccccaaatgcaaaaattaacataagagaaaaaccaatgacaaaacaattcacaatggaagatcgtttcaacccttccgccgtagagcaagcactctaccaacactgggaatcgcaaggctattttaagccgaatgaaaacccgaatgttccaagttactgcatcgctattccgccaccgaatgtaacggggagtttgcatatgggacacgctttccagcagacgttgatggatactttaatccgcttcaaccgtatggagggcaacaacaccctttggcaggcgggcaccgaccacgccgggattgcgacccaaatggtggtggagcgtaaaatcgcagcggaagagggcaaaacccgtcacgattatgggcgtgaagcctttatcaacaaaatttgggattggaaagcctattcgggcggtaccatcagccagcaaatgagacgctttggtaactcaatcgactgggatcgtgagcgttttacgatggacgagggcttgtctaatgcggtgaaagaggtctttgtgcgtttgcacgaagaaggcttgatttaccgtggtaaacgcttggtgaattgggatccgaaactgcacactgccatttccgatcttgaagtcgaaaacaaagagagcaaaggctcgctttggcacttccgctatccgcttgctaacggtgcgaaaaccgctgagggcttagattatttagtggtggcgaccactcgtcctgaaacgatgctgggggatacggcggtggctgtgcatccggaagatgagcgttatcaatcgctgattggcaaaacggtcgtgctaccacttgccaaccgtgaaattccgattattgctgatgaatatgtggatcgtgagttcggtacgggtgtggtgaaaattacccctgcccacgatttcaacgattacgaagtgggcaaacgccacggcttgccgatggtaaatgtgatgacgctcaatgccgatattcgtgcggaagcggaaatcattggcacagacggcaaaccgcttgccggctacgatgccccaattccagccgactatcaaggcttagagcgttttgcggcacgtaagaaaattgtggcggactttgactcgcttggtttattagaagaaatcaaaccgcatgatttaaaagtgccttatggtgaccgtggtggcgtgccgattgagccgatgctgaccgatcaatggtatgtgagcgtcaaaccgcttgccgaagtcgccaccaaagcggtggaaaacggcgaaatccaattcgtacctaaacagtatgaaaatctttacttctcttggatgcgtgatattcaagattggtgtatttctcgtcaactttggtggggacatcgtattccggcttggtatgatgaacaaggcaacgtttatgttgctcgagatgaggcggaagtgcggtcaaaatacggcttaacttcagacgtagcgttaaaacaagatgaagacgtattagacacttggttttcgtccggattatggacattctcaacacttggctggcctgagcaaaccaaagaactgaaaatgtttcacccgaccgatgtattaatcaccggttttgacatcatcttcttttgggtagcaagaatgattatgttcacgatgcacttcatcaaagatgaaaacggcaaaccgcaagtaccgtttaaaaccgtttatgtaacaggtttaattcgtgatgaacaagggcaaaaaatgtcgaaatcaaaagggaacgtgttagacccgattgatatgattgatggtatcagtcttgaggatttgcttgaaaaacgcaccggcaatatgatgcaaccacaattggcggaaaaaattgctaaagcaactcgtaaagaatttgaacatggcatttctgcacatggaacggatgcgttacgctttaccctggcggcgttagcgagcaatggacgtgatatcaattgggatatgaaacgtttggagggctaccgcaatttctgtaataaattatggaatgctagtcgttatgtattaacccacgaaaaagtggatctaagtgagggcgaagcggaatattcgttggcggatcgttggattgagagtcaattcaaccgcactatagacgcatttcgcaccgcacttaagcaataccgtttcgatttagtggcaaatacgatttacgattttacttggaatcagttctgcgattggtatttagagctaaccaagcctgtatttgctcatggtacggatgctcaaaaacgtggtacaagtcgcatgcttcttaatatattagagaaattattgcgtttagcacatccaattattccatttatcacggaagaaatttggcagaaattgaagggtgtaatgaagttatcaggcgataccattatgttacagccatttccacacgcagaggaaaatcggcttgatctagaggcggaaagccaaatgaattggttaaaagaagtgattgtagcggtgcgtaatattcgtgcggaatgtaatatttcaccgagtcatatgttggaactgttgctgagaaacatttcagaggaaacaaaaatttgtcttgaaaataaccgcactttattacaatctatggcaaaattgtccacgattactttactggacgccaatgaagaaccgccactttcggtcacgaaactggttgaaaataatgaaatttttattccaatggcaggttttattaataaagagcaagaactcacaagattgactaaagaaattgaaaaattgaaaggtgaaattgttcgaattgaaaacaaactcagcaatgaagcctttattaccaaagcaccggagcaagttatcgccaaagagcgggaaaaaatgcaggggtatttggataatatagaaaaacttcaacaacaatatcaggcgattgagatgttgtaagtatttaggtcgatatttgatctcccgccgtcaaatggcggtcgggagatcgatgttaatcgtggtgaaaatctatcttaggttctcccaagaataacggaccgagtggatttttaggcaaattgaagtgattaggatacttcacctctaccaaatataaaccatcaggtttagcagttggtgcggctaaagtgcggtctttttgagttaaaagccaatccatccattcaaccggctgttttccgcttccaatttctaaaagactgccgacaatattgcgtaccatatgatgcacaaaagcgttagcctgaatatccacaataatgtaattggcttggcgaaaaacatggagatgatgaatatttcgccatggtgtattagactggcattgtgcggcacgaaatgaagaaaaatcatgttcccctaataaatactgccctgcttggtgcattaaatgatgatccaatgcaacgtgatgatgagtaactccagtgggaaaaagagcggaacgtagtggatgattataaattaaataacgataacgccttgctgtggcactgaaacgagcatgaaaatcctcgctgacgacctttgcccaacgtaccgcaatatcagcaggtaaattggcattaagaccgaatgtccatgctttttcagagcgaatcgctttcgtgtcaaaatgtaccacttgaccggtagcatgaacacccgaatccgttctacccgcacaatatatttgacaaaattcatttgcaacaaaactgaccgcactttccagtttttcctgtacacttgtgacattcgcttgacgttgccaaccgaaataatgtgtaccgttatattcaatacctaatgctattttcatattattttatctgttaagctgaaacccattttatgatacttgaatatagtcgagcggtatatcacctaaatacgccaatagttcttctgtcataccacgatatgacaacctgaaaggttgttcaaccaataccgctcgagcaatattttccacctcatttccatttaaaagtaaataattcaatgctgtttgtagtggtggtaaagagggattaaatgcggcattttcagcataactgccttgaaaaatctgttgatcttgcaattgcaatgcaatacctgaataggttttggaataaggagcatgagattgattggcagcatcaagtgcggcttgaattaacggatcttccgttacaaaaaacaaattatgtgcttttttatcaaatagacgattgtctatctgtaaattgtggggtccaaaagcatccggcaaatagtgatgtaataaattatcctgactatgtggcaaatgaatgcgtaatgtttccgcactgttaagttcattcataaattggcgacaatgtccacaaggtgtgtaattgacggtaatctccgttattttactttcacgacgcatccaagcatgagaaattgcactttgctccgcatgaacggtttgctgaatgttcgtggtacaaaattcttgattagcaccaaaataaaagctgcctgactctcctttagcaattgcccccacactgaaatgggagattgtgggattagcataacacgcactgacgggtaataacattaaagccaattctttgtccgtcatatgatatttttcgcaaaaatggtttactgtgaatgcgggtagaaagccctgaaaattctgttcgcctaagatataccacagatcctgagccaaatttctgttttcaatttgatttaaagcctgtttaatccgatcagatatatgttttaatgaatgatgtgtcatcataaatccttgttgaatattgagattgggttgaatgtgccaaacatttaaaataacgtcaagtagatgttttaattgtatcttattatttttggctgaaaaatttccaattataacaagttaaacacttttaatatttcatcaaaaatataattttctgcattgaaatagttactcttttttaaacgacatagcataactcgccataaaattggatctttaatttttacgctgactaaatgaggatcgggataatagtacgctgtagataggggtagaatagtcaaaatatctgaattagattttgcagtgtaatataaaaaatcccaacaggctgattcatagatgatattagggtaaatattatgtcgttcagatgcttctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgttctggagagcaaaataccgagagttctgagcgataaatttcgaaagattcaataatcttagatgaaatatgttcaggatagagcaaggttgcaaaattgacattacctaataatagttcaccttttaatgaatatgcaccttgttcttttacttcaaattcaatttgaggattatttataatcagttccggcaaaattttagaaaaaatcaaagataaaattaaaggtggaataccgatagatattcgccctgtcatttcttgttctttcttatgtagatttttgttcatttgattgtatttcttgagtaattctttagcatcacggtagtagttttctccaacgtaagttaaccctctaatttttccattagctcgtgtaaataatgcaatattttcttgatgctcaaattcattaatcatcatacttaatgccggttgagaaatataaagattttgagatgtccgacttaaattgaagccgttttctacaattccaataaaataacgtaaatgtttgatatccatgatttctccttaaccaattttgtgttcagccgttctataagctgtgtttcttttgtattctttatatgtatctacattctataagattaatttataggtatgtaaaaaaactgtattttgaattattcgaacaaattactacacttacctcaaataaggtaagaatactagattatctagattttataagtatgcttgcttagtttttttgagatgtattgagcgttttactctctcaatgtataacaaaaatttaaccttaaatataaatttattttatctcataggaagatgctatgtctaaatttatttcaattgatgagctcaaatctcatttttttgatggaatgacaatgatgtccggtggtttcatggggtgcggtgctcccgaactcatcattaaagaaatcttagaggcaaacattaaggacattactctaatcagtacggacaccgcaatggtagatactggggtaggtcctttaattgttaatgggagaataaaaaaactatatgcctcacatatcggaacaaattctgaaactggtaagaaaatgatttccggtgaattaaatgttgaactttgtccacaaggtactttagcagagcgtattcgtgcaggcggatcaggattaggcggatttttaacgccgacaggggttggcacagtggtagaaaaaggtaaacagaaaatcactattgatggtgtggaatatttactggaactaccgttaaaagcagatattgcaattattaaagcggatattgccgatgagattggtaacttagtttttttaggtgcggctcgtaattttaatccaatcatggctctcgctgccaaaacagtcattgtacaagcaacaaaaatcgtgaaagtaggtgaaatggatccaaatttagtgatgacccccgcagcagtggttgattatattgtaaaagcgtaacggaaggagaaaaaacaatgaatgctaaagaaattattgctcgccgtattgccttagaattaaaagatggtgatgttgttaatcttggtattggtttgccaactatggtagcaaattatatcccaagcgatatttcaatcactctacagtctgaaaatggctttttaggtttgaccgcttttgatcctgaaaatcccgatgaaaatattgtgaatgccggtggtcaactttgctcaatccaagcaggaggtatgttctttgatagtgcttattcatttgctttgattcgtggcagtcacgttgatgcttgtgtactgggcggtttagaggtcgatcaagaggcaaacctagcaaactggatggtgccaggaaaaatggtacctggcatgggaggggcaatggatctagttactggtgctcgtagagtaattataggtatggagcattgtgcaaagacgggaacctcaaaaatattaaaaaaatgtactttaccgctaactgcacgtaataaagtccatctagtcgtgactgagctagccgtatttgaatttatcaatggacaattaaccttaactgaaatggcggaaggttatgatttggatatgattaaagctaaaactgaagctgaatttgtcgtttcgccaaatctaaaaacaatgtcgttggcaggtgcataaggagcttattatgattagccgtatttctcggtttatgacaactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncataaaaataaggaagcaactatgaaaaatgtcgttattgccagtgcggtgcgtaccgcaattggaaattttggcggttcacttgcagacacctctgctgtggaactcggtacagcggtaatcaaatctgcgattgaacgagcaggtattgatataactgctattgatgaagtaattatgggaaatgttttacaggcaggtcttggacaaaatcctgctcgtcaggcactattatgttccggcattgctcaagatgtaccagcttatactgtcaataaagtctgcggttcaggcttaaaagcagtagttctaggcactcaagcaattaaagctggtgatgctaaggttatcatcgcaggtggtatggaaaacatgagccaagcaccttatcttcttgaatccaaatctcgttggggctaccgattaggagatgcaaaagtacaagatgtgattttatctgatggtttgatttgtgctacaaaccactatcatatgggtatcacggctgaaaatatcgctaaaaaatatgatattacccgccaaatgcaagatgaattagcacttgcctctcaacaaaaagccaccgctgcgattcaatccggtgcattcaaaaatgaaattgtaccgttaaatatcaaaattaaacgcaaagaggtcattttcgacactgatgaatttgtcaaacaagattcaaccgctgaaggtttagcaaggcttcgtgccgcatttgataaagagggtagtgtaactgccggtaatgcgtcaggtattaacgatggtgcggcggcattagttattgttgaagaagaaacggcaaaagcattagggttgaatattcttgctcgtatcaaaggttatgcaagtggtggcgtatcaccagatattatgggaataggacctgttcctgctactttaaatgctttgaaaaaaacaggtttgcagttaagcgatatagacttaatcgaagctaatgaagcttttgcggcacaatttttagctgtaggtaaagagttaggggttaatcccgaaaaagttaatgtcaatggtggagctattgctcttggtcatccaataggtgcaagcggagcacgtattctagtcactcttttacacgcaatgcatgctcgtgataagcaattgggtttggcaactttatgtattggtggtggtcaaggcattgcaatgattgtggaacgtatttaataccaactggaaaaaaaggaaaatattatggttaaaaaagtggctttaattacaggtgcagcaagtggtattggtttggcaatatgtgagagccttgcaaccgaagatttaaatatagtgatggtggatgtaaataaagagacattaaaagaacattccactcgtttaggaacggcttatattcaagcagatctttcgaaacgtgaaggttgtaaaactgcggtagattttgcagccgaaaaatttggtagcgtagatattttggtaaatgtagcaggtatccaaaatgtagccgccattgaaaatttttccgaagataaatgggattttatgattaacttaatgcttactgcaccatttttgcttactaaatacagttggaaatacatgaaagcaaataaatggggacgtatcattaatttgaattcaatccacggtttagttgcatctgatttcaaatctgcgtatgtttcagcaaaacacggtttatcgggcttaactaaagtagctgcattggagggtggtgaatttggtattactgttaattctatctgtcctgcttatgttcgtacaccgttggttgataaacagatcgtagatcaagctcgtaatcatggaatttccgaagatgaagttattagcaaaatcatgctttctaaagctgctgttaaacgcatgattgaaccttcagaactcggcgaatttgtcaaatttctctgttctgattcagcagcatcaatctctggatcttgcttaacaatggatggtggttggactgctgcctaaaaatttatggaactggggaaattaatggaaataatcccccgagtttctctttaacttaagaggaaatatcatgagtactatcgcaattattttttcattattgatgctgatgtacttcgcatacagaggtatgacagttttattattagctcccttactggctgcttttgctgtcttactaagcggtgatggatcaatgatgatgccaaaatatacagaaacttttatgtttgcattaagtggctatttacttaattttttccctgtgtttctatttggtgctttattcggtcagttaatggcagattctggtgctgcaacaggtattgccaaaggcattgttaaaatgttaggaagtcggcaggcaattctcacagtgatcatcgcttgcggtcttttaacttatggaggcgtgtctctttttgtagtagcatttgcgatctatccgatttcaaaagtgctatttcgtgaagcgaatattcctaaacgtttgattccggcaacgattgccctaggttcatttactttctcaatgacggcattaccggggacaccggctgcaaccaacgcaattccaattcctttttttaatactaacgcatttgccgctccgggattgggtttaattggtgccatgatcatgttgataggtggttggttatggttacaaagtcgtgctaaaaaagcagcttctttaggtgagggttatggtaaacacgatagtgaatcaagtgcggatttagctatattcgagaaaaatgtaatgccatttagtttatcactacttcccttagttcttgttatcgccatgaatgcaatttttacttatactttttccaatatggactttagctcattgcaagaggtctttccaaatctcaacattaaaggcaagactggattatgggcaatcatcgcctcattattaattgcatgtgtagtattagtatttttacgtcttggtaaatggacatcattacaagaaactatcaataaaggtgtatatggttcaatgttacctatttttaatacggcttcagaagtaggttatggagcagtagttgcttcattagccggattcgctattattcgagactcagtgctaaatgtatcaactaatccattaatttctgaggctgttgcaatgagtgtgcttgctggtattacaggctcatcatcaggaggattaagtattgcaatgagaacgcttggagcagactacctacgtatgggaattgaggcaggtattgatccggatttattgcatcgagtagcagtaatggcagcaggtggatttgatactttacctcattgcggtgcaataattactttactttctatctgtcacttgaatcataagcaatcttacttgaatattgcggctgttaccattgcaataccaatagtagccgtcattagtgtgattgcattaggcacagtgtttggttcattttaagtacaaataagtcgaaaaatggaaagcttatcctgcaagtagttaaattttaaaaatttcttataggaaatgtagcaaaaacagaaagtgaaatacttatggaactgttacacgatatcaacaaaattaacccacttaaaaaagtgggttaaatttaataaaaaggtttatttcaagcaactaaaatagctatctgcggtatattgtaagaaattggcataggaatttttacctaatttaactttgtcacccatcggatccaagcgtccaacgtttacacctgttgctttacctaaactttcaattacttttggtgtaaattgcggttctgcgaataagcaatttactttatgctcagtaatttcttccttaattttagctaatgtttttgcccccggtgcaactaatggattaatagtgaaatagcctacttgatttaatccataagcgttattgaaatagctgtaagcatcatggaaaacataaaatcctttttcttttactgaagctaattgctttttaatttcgttattttttgctgctaaagtgcggttaaattcagcaagatttttttcaatcaatgcttttttggccggatattgtattgacaatttctctgctactttttgtgcaacaattttgctaatttccggtgagtaccaaacatgccaattaatgcccaattcatcatgttcatgattgtgtccatgcttgtgttcatggtcatgtttgtggtcgtgatcatgatcgtggtcgtggtcatggtcatggtcatgmtcgtgktcrtggtcatgtttgtggtcgtgrtcatgatcgtggtcgtggtcatggtcatggtcatggtcgtggtcatggtcatggtcrtggtcrtggtcgtggtcgtggtcntggtcrtggtcatggtcgtggtcatggtcrtggtcatggtcrtgrtcatggtcgtgatcatggtcgtggtcatggtcgtgatcatgatgatggcctgtcattaaaagtcctttagtattaatttctgaaatttcagcaatggtaactacttttttcggatctataccacgtaaagttgcatgatctaaaaacgcatccacatcttcgccaatccaaacaactaaatctgctttttttagtttttgaatatcggaagggcggaaactatagtcatgcggagaagcacctggtggaacaataacttgggtatcagttacaccatcagcaatagatgaagcgataaaacctaaaggtttaattgatgttactatgctagcatttgccacagcagataaagaaaaaagtgctgtactaattaatgcttttttaaaggtaagattagacattggaatactccttttcatgattaataacgattttaaaagacggactaggttatcactttttcatcaaattactagaatttttacaaaactttttagcctttggctaatttatttattatttttgctactgcaaaaaagccaaaagtcgctgttatcattgttgctgcaccaaagccattggcacaattcatggtagctgaaatagtacaattatcagccatttttggaaaaattaaaggctgagtggaaaagacacaatcgactgcaaacttacgtttaggattttgcggaaaatgatattctttacgtaaaactgaccgcacttttgctagtaaggggtcttgaatagagcgactaagatctgctactcgaatttgacttggatcggtttgccctcctgcaccaccaattgtgataatcggaattttattgcgtttacagtgagcaattagtgctgcttttactctgacattgtcaatagcatcaatcacataatcgtagcctgtatgaatatattcagctaaattttcagcaagtaaaaaatcatcaataatattcacgtggcaatccggattaattaattgcacacgttctttcatcacttctgtttttaacttgccgatattacctgttagagcgggtaattgtcggttaatattagttacacagatgtcatccatatcaatcatggtaatttgcccaataccgcaacgtgcaattgcttcgacaacccatgaacctaccccaccaatgccaatcacacaaatatgtgtttgctttaagcgttccaaaacgtctattccatatagtcgtccaattccaccaaagcgttgttcataattatcaatacgttctgtcattattgtaataaccacactctaccatagtgcttcgataaacccgcaatatgtccggcattatcgccaattccacgatataaatcaaaatgctgcccttttactgctcccccaacatctaatgccaccattaaatgtaaaatatgttcaccggtccaattgccttcatcatcaattttcggtacttccactaaaactacagagccgcttgggatcacatttttatcgctagcaatagcagccataggtactaaaggcacaccggcagaaccaagcacttttccgttaggatcttttttgaaaaaaacataagaaggattacgttctaacaaggcttgtaagcgtgatggattttccattgcccaatttttaatggcttgaatagacattttttctttggaaatttcgccatcctctaccagcaatcgtcctattgctacataatcaaaaccattttgtcctgcataggcaaaataggtcaaatctccgtgaccaaaatcaacataaccgctaccttgtacgccaagtagaaaattatcaatcattgaatcagtgtaagccagctcaagtcccttaccttgcaaggcaccggaataaatttgagctcgagaaaaacgtttattagcaggcaaagcataaataggttgattatatttgccctgttgcgtatgacgagcatgaataaccggcgaataatatcctgtcattaatacattttggtatccgtcggttcctttcataatttgagcttgaataccatagtctgctaattgtttagtattcgcacccgccaatacccaatgagttactttgtcataaatgttcgcaaattgattagctaagccagttgatgcttgacgaatattagtaagttgcgttaaaaaatcaccttgattgatgaccgcacttttgttgtcaacagaggaaaccggcactaatgacgcttgctgataactacgcccagcatattttgccccgaattgtttcgcatcattttggctagctgttttagagtgttcggaagaacatgcaaccaaaatagcgaccgaaaataaaatactttgtttaactactgttttgataaaaaataccatatgttaccgaaaaaccgcataattagagacgtcttaaattagcaaaaaaactgtggaatatacagtcttttatcattcaatgaagataaaaaatttacaattcgcttcattttatcattggttgttttgttatttacactgatgcaaaatgtttttacgcttgaaccgtcaaataaaagcgcggtgttaatttagactactttgagtattgcaacgtcagggcttgattttgcagtccaagccctcaaaattatttaaaactcaccgcacttttaggcttcattaattccccaaagccaagccgccccacgcacaccactggaatcgccgtgtacggcttttttgatttcagtaaaaaattctctaccgaaaatataatcgttcatccgtgtcggtaaggttgtgtacagacgatcaatgttacaaacaccgcccgccagtacaatcacatcaggatctaaaatatttacataagctgctagagcttttgccaaacggcgttcataagcttgtaaagattgttcggcagtaggatcgccttgctcggcaagtgcggcaatttcgttgccttttaatcttatcccactccgacgttcgtaatcatcacatagaccggtaccggaaacaaattgttcgatacaacgatgtttgccacaataacattgtacgttatgcgaacgttcttcttcatcttgccaaggtaattcgttgtgtccccattcaccgccgataccgttagccccattccaaggttttccgtcaatcacgataccggaaccgcaacctgttccgagaataagtgccaatacgaccttttttcctgctcctgcaccatctgtggcttcagagacggtcatgcagttggcatcattggcaattcttatttctcgtcctaaaagtgcggtcaagtcttcgtataaattttgtccgttaagccaaacagaattagcatttttgacttttccggtaaaaggggaaatagtgccgggaattccgatccctactgtgcctcgttgccccgttgcatgttccgcatcatctaccaaacttttaattgctgtcaacgtgtccggatacgaccctcttggggtaggaatacgtttgcgaaacaactcttcaccgctgttacttaacgcaataacttcaatcttggttccacctaaatcaatacctatacgcataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacatctgctatactttctaacgcaccgccttcatcgccacccacggcacctaattcaccttccacagaaatattataagggcgacataattccactatttctctagtttgacgaatattttcttcataagataaagaagaaccatcaaacataatagaggagaagccacattcaatggcttgtttgacggttggtaaagttaaaccatgatcgaggtttaaacaaactgggatacttgctaattgagctttctttttaatgtatttggcggtcgcaggtaaatcgatatattgcaaatgtacttccgcgacattaataatcaccggtgattgctgctgtttagccgcagcaaatactgcatcaataaaattggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagtacagttgaaagtttttctattttaaccgcactgagtttcagcataaatacagttattgactaaattttatgttatacatcgtaaatatttctaatcagactcacaaagaatttagaaaatcttgttttatttttgtgatcttcatcacgattttatggtgtgaatttataaattgtgataaatatcacatttttatcactgattaaataataaaaaatgtgtcctacatcacaaatcttaaagaaaaaatttttgtttttattataaatatgttattttttctgcctgaaaaatagccaattatttctctttacgtgttctatttattgaggttaagttatgctatcagcaaatgcaaaagtcaaaatccaaagtgttggacgtttcttatcaaatatggtgatgcctaacattggggcatttattgcgtggggttttattaccgcactttttattccgacagggtggttgccaaatgaaaccttggcgaagttagtcggaccaatgataatgtacttactgccattattaatcggttatactggcggtaaattagttggtggagagcgtggtgcagtagtcggggcgattactactgccggtgtgatcgtcggtacggatattccaatgttccttggtgcaatgatcgcaggtccaaccggcggctgggcaattaaacgttttgacaaatgggctgatggcaaaatcaaaagcggttttgagatgttagtcaataacttctcttccggtattattggaatgattttagccattctattcttctggattatcggaccagctgtaaaagtagtttccggttggttggctagcggtgtagatgtacttgttcaagcaggcttattgccactcacctcaattttcgtcgaacctgcaaaaatcttgtttttaaacaatgcaattaaccatggtattttttcaccgttaggtatccaacaatcacaagaattaggtcaatctgttttcttcctaattgaagcgaaccccggtccgggcttgggcgtgttgttagcttatatgttattcggtaaagggtctgccaaacaaacttccggcggtgctgctgtaattcacttctttggaggtattcacgaaatttattttccttatgtgttaatgaacccacgtttattaattgcagtgattgcaggtggtgcaacaggcgtatttacattggtattatttaatgcaggcttacaagcaccagcatctccgggggcaattattgccgtgttagctatgacaccgaaaacctctttcatcggtgtgattttatctgttatcgcctcttgtaccgtatctttcgtcatttcttctttcttcttgaaaatttcaaaagaagaaagcaaaaataccctagaagaaatgcaagcagcttctaaagcaatgaaaggtggtaatacagcaacgaaaagtgcggtgatagatttgaacgaggtgaaaaaaatctttgtttcttgcgatgccggtatggggtctagtgcaatgggtgccggaatgttacgtaagaaagtaaaagatgctggcttgacaattgatgtaactaactgtgcgattaatgatttaccggaagatgcccgtttagttattactcatcaagatttaaccttgcgtgcgaaaaaacaagttccgaatgcaatacatttgtcattacaaaacttcttagataacaaattctacgacagtttagtgcttgatttgcaagctgcaacaaaagatgctgtagtaccgatagcggaagaaaatgcgattgacgtcaagggtacaacatttactcttaacgcagagcaaattttcttgggcttgaatgcagacagcaaagcggatgccattcgtttcgccggtgagcaattggtgaaatttggtttcgtgcaaccaagctatattgatgcaatgtttgctcgtgaagaattagtttctacttacttaggtgaaggtttagctgtgccacacggaacagcagaagcaaaagatgcggtgttgaaaaccggtattgtagtttgccaatatcctcaaggcgttcgttttaccgacgaagaagacggcgtagcgaaattagtaatcgggattgcggcgaaaggcaatgagcatattcaagtactaaccgcaattactaacgcattggatagcgaagaagccattgcaatactaacatcaactgatgatatagaaaaagtgctgaccttattgaaagcttaaaagtgcggtaaaaaatggcgtagttttgactacgccatctttgtttataattttattgattgggagagcaaaatgaacgcattacatttcggagcaggcaatatcggtcgtggttttatcggcaaagtattagctgatagcggagttcaagtaacctttgccgatgtgaatgaagcggtaattgatctattgaaaagacatcaatcttacaacgtgaaaatcgttggcgacagcattaatgcgatggaaagcgtacgtcatgttacgggggtagattcaaaagacacaaaggctttgattgagctgcttaaaacggttgatttagttaccactgctgttggtcctaccgtgttaaaaattatttccggaactatcgccaaaggtattgaagctcgtttaaccgcaggcaattttaagccgttaaacattatcgcttgtgaaaatatggttcgtggaacgacctttttaaaagagcaggttttcacacatcttacagaggaattgcaagcagacgctgaaaaatatgtaggtttcgttgatagtgcggtagatcgtattgtgccacctgtgcaagaagatatatcggatcctttgttggtaacagtagaggaattttgtgaatggatcgtagataacacccaattcaaaggtgatattccaaacattcaaggaatggaattaactgataatttgatggcatttgtagagcgtaaattattcaccttgaatacaggacacgccgtgaccgcttatttcggcaaacgcaaaggctatcaatttgtgaaagaaagcattgaagatcccgacatcaaagagtttgtagcggctgtcatgcaagaaagcggtgcagtgttaattcagcgttacggttttgaaccgcaagcacatgccgcttatattgaaaaaattctcaagcgttttgctaatccatatttagtagataatgtggaacgtgtgggtcgccagcccttacgcaaattaagctacaatgatcgcttaatcaaaccattgcgaggtactattgaatacaatttagctaatcagcatctaattcgtgcaatagcttacgcactgactttccgttgtgaagatgatccgcaagcagtagaattagcacaatctttggcagaaatcggtgtaacagaaacgttgaaaaaatatacggaattgcaagatgtcgttattattgagcaaatagctcaagcctataatgaagtaaataaatcttagacaaaagagcggtcagtttgcaaaacttcctaaaaaatgaccgcactttctctttcaagcataggaaaaacaagttgttatctgaagatcctatttatgaaaaattaaacggtactgtttccgtgcgaggttttatgattgctactgtggcaatttttgaagaggcggtagatagtctgatcaatcgagtatttcgaaaaacagattttgtggtgcagtcggtgattgactctctttttaccaacgacggtcctcttggtgatctcagtgtacgtctcaaagtgttactcggacttggcgtgatccaacacaatctattttccgacgtaaatgcctttattcaatttaaggaaacattaaataaggacgaaaaggaatacactttcgatgatgaaattgtactcacttttttgcaaaaattaacgctgttgatggataaatcagcacttgattttgagccattaatcgaagacaaaaacagccttacttaccagatgaaatctctgcgacgggaaaaaattattcgttcttgtttaatattgaccattgcagatatttaccgtcaattacaaatcgaaagtccattttgatcatttaaataaattggtacacaacacaaaggtaagcattgattttacagctaaaaacgcatcttaaaaaacaggtaaacaggtagtataagatgtctataatgaattttttagctgtaatttttccagtaatttctgatgaattcccccaaaactaccatttgacatgaccaaaatatgatcttcaggttgtgcctcagtaacaattaaatcaactaagttgtccagatttccagaccattttgccggttgcacacaatcattagcaatttcaactacattccaaggaatatttttcggttgcaataaaaaaacataatccgctcttgccaatgccggtgctatttcatctttatgaattcccattttcatcgtatttgagcgaggttctagcactgccaaaatacgtgctccgccaccgaccttgtctcgaagtgcggttaatgttgcaagaatttctgccggatgatgggcaaagtcgtcataaacagtaactccatttacttcaccttttacttccaaacgacgtttcgcattaacaaaagaatatagtgcttgacaagcatccttgacttgcacgcccacatggtaagctgccgcaatcgccataagtgcattattcatattatgttgaccgacgatattccattgcacttcaccggctttttttccctgatgataaacagcaaaatgcgaactgtcatgagctattctttccgcatgccattcctgatcttgtcccaaaaaatgcatttcagaccagcaacccatgtctagagtttctgttacagattgttcatgagcaaaggcaagaatacgaccgctcttaggcattgttctaatcatatggtgaaactggcgttgaatcgcttgtaggttgtcaaaaatatctgcatgatcaaaccctaagttattgataataagcgtttttggattgtaatgtacaaatttggaacgtttatcaaaaaatgctgtatcgtattcgtcagcttctataacaaaaaatggactcttgcctaagcgtgctgaaacaccgaaattgccggctattccacctattaagaaccccggttgcaagccattttgttctaaaatccaacttaacataccggttgttgttgttttgccatgtgttcccgatacggcaagcacccagcgatcacgtaataaatgctcgtgtaaccattgcggacctgaacgataaggtaagctattttccaacacatactctacgcaaggattaccacgtttcattgcattgccaatgacgactaaatcaggtgctggttgcaactgcgaaacgtcaaagtgcggtatgatttcaataccattttgttgtaaaaaagtactcatcggagggtaaatattcgtgtctgaccctgtgattttatagcccatttgtttggcaatgatagctactccccccatgaaagtgccacagatacccaaaatatgaatatgcttattgttcatttgtttctattccccaaaatgtataaaaaatgtgttatagatcacattgtgagaaatcaattcattcgttaaaaagtgaaggttgttataataaagcaactccaactgagagtaaatttaaattatggaaggattaaattatgaaaacattaggacaatttattgtagaaaaacaagcagaatatcccaacgctaaaggagagctatcagggattctatcttccttgcgtttagttgccaaaatcattcatcgtgatataaataaggcaggactaaccaacaatattattggtaattccggcgttgaaaatgtacaaggggaaacgcaaatgaagttagatttgtttgcacataatacaatgaagcaggccttgattactcgtgaggaagtggcaggatttgcctccgaagaagaagaaaattttgttgcctttgatactgaacgtggtcgcaatgcaaaatatgtcattcttaccgatcctttggatggttcctcaaatattgatgtcaatgtggctgtcggtacaattttttcaatttatcgccgtgtttctcccattggtacacctgttaccttagaagattttttacagccaggacataaacaagttgccgccggttatattgtatatggttcatcgacaatgttggtttatactacaggcaacggtgtaaacggctttacttatgacccctctttaggcgtattttgtttatctcatgaaaatatccaaataccgccaaacggtaaaatctattccattaatgaaggacagtatttgaagtttccaatgggggttaaaaaatatattaaatattgtcaagaaaaagataagtctactgaccgcccttacacttcacgttatatcggctcgcttgtttctgactttcaccgcaatatgcttaaaggcggaatttatatttacccgagtgcaacgacttatcctaaaggaaaattacgcttattatatgaaggtaatccgatggcttttcttgctgaacaggcaggagggatcgcaagcgacggcaaagatcggattttagatattcaaccgaaagaattacacgaaagagtaccgctctttgtcggctcaagagaaatggtcagaaaggccgaagaatttatgcgtgaattttctgaagaataaccatttgaaaagacactgttttgtgtcataaaaaatctgcaccttaatcagttgattatctagttcaacttttggggtgcagattaacatgtatatcggttttgagccttacttgacagaaattagaatttataatttacatttaaaacaaatgtgcgtcctcttgaatagttgtttaaggttttttggtacccatcgcccacaccaaaaataaaggtcatttggcttgcagaatcattattcgcatctaatgggctaatatatcttttatcaaagacattttgaatttcccctttaatggttaaattttctgtcggttgatagatggcataaagatcaaaaatcaccggttgtgctttgatttcttctgtaccggcaattcgtacataagtaaggtatactttgccatctttagatttgaacgtccccggtaagataacatcgccatctactttatcaactttagctcgtttacttttaccgtagtatttggcaatgccgcctaatgttaattttccgtcaaataaacgtgttcctaggtcaagggaaccgtaatctttcggtagagacgatattttacttaagccgaacccttgtaaatattttccactgctactaccgtcatttacagcactactggaatcggaatatgaacttggctgattggttttttgtctagcataggataaattggcatagaaccaaccgatatcataatttaattcaaattctattccttgcattttaacaataggcgatgaagcaacaggaatgatctccgcttccgtaccgccggtaaactcttgtggcttaaaaataccgtgagtttgtgctgctgctgtagaactaagtttattttctgcttttttatagattgttttacccccttcgtagttaatatgggtaatatgtgcaacgcagtcatcaacggatacaggtttatcttttcctctatagctgttcgagctacattcctgtttgacatttaaaatataatctctgattttcgtttgatacgccaagattttaaagcccagtacgtcgaaatccgaaaatacgccatttttataaccgttaatcccgaattgaatagttttggctttttctgattttaaatcggttctcaccgctaaatcaccgatttcagagaaatacatttctttgatatttgggacacgatgggttttggcataactgacaaagggcgaaaagagcgggtgaaaatccgccgagaatgaagccgaataattatcatgtgatctggaaccgcctttttctagggtatattccataggtctacatccagcaatatcaacatacccattataaaattttggagtgcatcctaattttatggcaccttctactccgtataaatcaacaagatcttttgaggtattatctacccatacagtgagacctcgatatttttttcttgtctcatcccaagctccattaataaacctattccgtcgaaaaacctgtccactgtatttataaatttggcgattggcatttaattttaaggtataaatatcgtatttaaaggtttggtcaaaatagagggttttaaaacgttgttcgccgtcaggttggaacgtattggattttgtgctgtgataaaaacaaggaagataacctggttcacctctatcagggcaataatataaattcggagcaaaagttggctcaccattctcaaaattataggctaattcacttggatggcgatttttactgtatttatttttgaggatattggcacctaatgttgcttcataagagaatttttctgttatcggaatggaaaaactcatatttatatccatggtttttgcactatttttgctttccaacatatctttcagctttttgccattaaatacgcttcccttgtgataggtttgcgtagaggtattatctgccaagattaattcaaattgtaaattctctttcgggtttaattggtagtttaactggtaatttttattctctaaatttctgccggaaagtgcggtcgataaagtgcggtatgaaagaatggctttattatatttatcattatattcaattttggctaaatggcttttgggataatggagtaatttatttggatcatagggttgacgattgtacttttctattgcttgcagagtacaatgatcttgccaaaatccccctttacaactttctcgtgccagtctcggtaaattatcttctctatctacatctacaatattcgttccaccacctactttaaaattttgtgagcttttacgccaactataggcatacataaaacctaatgttcttgtatcggaaaaaggatagcgaaaggcaaccgcacccatataattaggccctatagcgtttgtaccccccccgcattcaataaaatacccgctctattaccttcacttatcacatcatcaacaccgattgttctaaagttagcagatccgattaacccatttacaccgccttttccgctaacgccaccacgttgaatatctacactggtaataaacgcagggtcaatggttgcaccgaattgagaggttccaccggatttttcgctgttatctcccgatgtggcaaaaaaggtttgggaaataccgtccaccatcgtattcacccgtccaaatcccgtttgaccacgaacgttcaccgataccgtccccgaacttttatcaaggttggtaaacgcacccggtaccgttctgatgatgtcatcaatagattgcgttgacgtggaaatattttctctcacactggttgcccccgcttttttaaagacttcctgtttaggtggtagcttatattctacgttaatttgatcgagcatttcttccgcataaacacaagtgcttaatacggaaaaagctaccgcagtgagtttaaatttattagacataattttcctacttatgtatggttaaaaagattggtaaaaaagtagggcagttatataaaaatatccctcgcatgtcaattaatgataataatttttattattgttttatttccaagaatatgtaaagcctactgtgccattgcatttttatacaccaaatctgtaacgccaaacacaacggcactgtttcccgacttaatgtccgcactggcagtgtctgccgaggcatctaatttggaatcgtcagcgactaataaaatagtcgatgcattagctactatctaattgcattttaccggtcgagtagcaacgttccatttgattttaaagatggtattcatagtgggattccttgtgtgaaagataaaaaataagacctagttctcatatgccaagaactaagccttatcgaagaaatgaataaaaaagaggtgtattcgttagttaaaaacgaatacaatcgtgctgtgctgtcatcatagattatgaatttcttgcgtcattcttcaaaccgtctggttgtataaaaaataaatctttttgtctaactctaacaaagaaataaaaatacatttatactgaaaattttaatttctttgttttcattgcataatagtaaaaatctcatagatggaaggaaaaaataatgaaaaatatgttactgatgagcagttctaaatacaaagataccggttacttaattcatacattaccttggttggatcaatttttgatggcatataaaggtaaaaagctcgcctttatcccttatgccggcgttactcgttcttttgatgaatacgaaatagcggtgcaacaagctttatcttgtttaggcatggaaattatctccgttcatcacggcaaaaaacatgcagatattattgagcaagccgatgtgatcggtattggagggggtaatacgttttgcttattacaacggatgtatgaatataatgtcatgaatattattcgggagaaagtaaataacgggacaccttattttggttggagtgcaggggcaaacgtagcaggtagttcaattatgacaactaatgatatgccgattatttatccaccatcttttactgcgttaaatctatttccacatcaaatcaatcctcattttatttcaagcaaaattcaagggcataatggagaaagtcgtgaggatcgattaaaagaatttttaatcatcaatccgaccgcacttgtatatgcgttgcctgaaggtactgcgttgcatgttcaaggagaaaaagcaacagttcttggtgaacaaaaggtgttacgttttagcgaaaatatgcaactgagtaccttagcacctcattcgacatttaattattaaggatataactatgatacagtttaattctattgtggctattcttggcattatcgccacggtttatcttctcattaaaaaatatgaaactcgtacagtattaatcagtgttggtttgttgatggcaatgttgactttcaaaccaatggaggcgttagatgcttttgctaaatccatgaccagtagcggtttaatcatggctatttgttccagtatggggtttgcttatgtgatgaaatacactcaatgcgatacacatttggtacatttaatgactcgtccgttaagtggtttaaaattctttttaattccgattgcaacagttattacgttctttattaatatcgctattccgtcagcagcaggttgtgcagcggctgttggtgccactttaattccagtattgaaaagtgcgggtgtacgtccggcaacggcaggtgcggcgattttggcagggacttttggttcaatgatgagtcccggatcttctcatagtgcaatgattagcgaaatgtcgaaattgaccattaccgaagtgaatttgtctcacgcaccttacactatgattgcaggtgcaatcggcacagtagttttaactttgttagcgattgtatttaaagattacggtgaggaacatcggaaagcctatttacaagaaaatcaacaaacggaaagtactttcagtaaggtgaatatattctatgctttagcacctctcgttccattgattatattggttctcggcggaacctctttagctgaaaacccaggattagcgtggacaaaaatgggcgtgccacaagcaatgttaattggtgcgatttatgccattttagttacccgaatttctccggttaaaattaccgaagaattttttaatggaatgggtaattcctatgccaatgtattagggatcatcattgccgcaagtgtatttgttgcaggattaaaagcgacaggagcggtagattccgctattgaatttttgaaacattctaacgaatttgtccgttggggagcgactatcggaccattcttaatgggtttggtaacaggttcaggtgatgctgcggcaatcgcatttaataccgctgtaacaccacatgcagtggaattgggttatacccatgtcaatttaggaatggcggcggctattgccggagcgattggacgtaccgcttctccaattgcaggagtaaccattgtttgtgccggtttagcaatggtaagtcctgtagaaatagtgaaacgtactgcactgggtatgattttggcaaccttatttttaacgttatttatgttataaatataagtaagactgaccgcactttgataattcatttgacaaggtgcggttaaagtttggagagtttaatgggggatatatgacgaatttagctagattaattgaatggcgaagagaatttcaccgttttcctgaaactggttggacagaattttggacaaccagtcgcatcgctgattatttagaagaaatgggggctgagattttactcggcaatcaaattattcattatgattttgtgcgtggtcgtgatacgaaattagttgagaaaggcattgaaagtgctatttcttatggtgcaaaaaccaaatggctagaatgaatggctatacaggttgtgttgctgtatttgattctggtaaacagggaaaaaccttggcattacgctttgatatagattgtgttaatgtgactgaaaccaatgatcctaatcatttacccaataaattaaaatttgcctcattaaatctagggtttatgcatgcttgtggtcatgatggacacatcacaattggtttaggtattgcgtcatggctttcacaaaataaggataaatttaacggtaaagtcaaaattgtctttcagcctgctgaagagggagtgagaggcgcagcagctattgctgcaagtggagtgattgatgacgcggattattttgcctcttcccatattagcttttgtgccaacacaggtactgtcttagcaaatcctcgtaatttcctttccacaaccaaaattgatattcgttataaaggacgacctgcacatgctggtgctgctccacatttaggtcgaaatgcattattagcagcggctaatgccgtaacacaattccatagcattgctcgtcatggtgaggggatgtctcgaattaatgtaggtgtattaaaagcaggtgaagggcgtaatgtgattccgagcagtgcggaaattcaacttgaagtacgtggtgaaaataaagagattaatcaatatatggtggatcaagttatgcaaattgccaaaggcattgcgattagtttcgatgtaagttatgaaactgaaattatgggtgaagcagtggatatgaataatgatcttgagttagttaaattgatcgaggaaattgccattcaacaacctggaatcaatgagtctactgctgattatgcgtttaatgccagcgaggatgcaacgattttagggcgtcgtgtgcaagatcatggtggtaaagcgatttattttattattggtgctgatcgtacagctgggcatcatgaggcaaacttcgattttgatgaaaatcaattgctgactggggtaaatatttatattggtttagtacagcggttattggggtagtattgagtttttaatttattttcgattaaaaagtgcggtcagtttttcatgaaaattaaaactaccgcacttcttgtctattgaattattaacagttctagcagttttttttgctttcaggtacaatcagccgattaaattttatcttatattaatgaaaaacttttagattttatttttatgaaaaatattcgtaacttttctattattgcacacattgaccatggtaaatcgactctttccgatcgcttaattcagagttgtggcggtctttctgatcgtgaaatggaagctcaagtactagattcaatggatttggagcgtgagcgaggaattactattaaagcacagagcgttactttaaattacagagctaaagatggtgaaacttatcaacttaactttatcgatacaccgggacacgtggatttttcctatgaggtatctcgttctttagcggcttgtgaaggggctttattagtagttgatgctgggcaaggcgtagaagcacaaaccttggcaaactgttataccgccattgaaatggatttggaagttgtacctattttaaacaaaattgatttgccggcggcagaacctgagcgagtcgctgaagaaattgaagatattgttggcattgatgccattgatgcagtgcgttgttcggcgaaaaccggtgtgggtattgaagatgtattagaagaaattgtacgtaagatccctgccccggagggtgatccgaatgccccgttacaggccttgatcattgattcttggtttgataattatttgggtgttgtatctttagtgcgtgttaaaaacggtattttacgcaaaggcgataaaattaaagttatgtcaacgggtcaatcttataatgttgatcgtcttggtatttttacaccaaaacaagtagatacaacagagctgaaaacaggcgaggtaggttggcttgtttgtgcgattaaagacattttaggtgcaccggtgggagatacattaacttcacatcataatccggcaacctctgtgcttccgggatttaaaaaagttaaacctcaagtttatgcagggcttttcccaattagctctgatgattatgaatcatttcgtgatgccttaggtaaactaagtctaaatgatgcgtctttattttatgaacctgaaaattctaccgcacttggcttcggttttcgttgcggttttttaggacttttacacatggagatcattcaagagcgtttagaacgtgaatatgatcttgatttaatcaccactgcaccaactgtggtttatgaagtggaacaaaccaatggcgaagtgatttatgtagatagtccggcaaaattacccccactaaacaatattgctgaaattcgtgagccgatcgcagaatgtaatatgcttttgccacaatcttacttaggtaatgttataacactttgtgtagaaaaacgtggagtgcaaacgaacatggtatatcacggtaaccaagtggcactgacttatgaaattccaatgggtgaggtcgtgttggatttctttgatcgccttaaatcaacttctcgtggttacgcctcgttggattatggtttcaaacgttttcaagcagccgatatggtgcgtgtggatattatgatcaacggtgaacgagttgatgcgttagctttaattgtacataaagacaatgcacaatatcgtggacgtgaattggtggaaaaaatgcgagaacttatccctcgtcaacaatttgatattgctattcaggcggcgatcggcaaccacattatcgctcgttctactgtaaaacaattgcgtaaaaacgtattggcaaaatgttatgggggagatgtaagtcgtaagaaaaaattgttacaaaaacaaaaagaaggtaaaaaacggatgaaatctttaggtaatgtagaagtaccgcaagaggcgtttttagctattttacatgttggtaaagataagtaaggaaacaccaatgtctaaatcaaatctatttttcgttatattaattgtagcgggatatgccatttggaaattgcttgatcatttggcactaccgaatacattcaatattttattaattttattgaccgcactttgtggtgttttatggtgctataaccgttttgttatcttgcccaagcggagcagacaaattgctcgtgcagagcagcgtagcggtaaaatattaacggatgaagaaaaaagtaaaattgagccgatttctgaggggagtgaattgttagcttccctatttcctgtattgactttcgtacttattttacgttcttttctttttgaaccgtttcaaattccatctgtttctatggagccaaccttgcgtgtcggggattttttgttggtcaaaaaatatgcctatggcattaaagatccgatttttcaaaacacacttattgaaacgggaaagccacaacgtggtgatataattgtctttaaagcacctttagaaccaaatattgattatattaagagaatagttggaatatccggagatcgtgttttttatgatgaaaaaacgcgtcatgtgacaattatttataataaggacggcaaagaatgtgtttatgattgtcaaataaaggaatttagttacagcgagccacagcgtaatcctgaatttaccatgatcgttggtaaggatgcacaaggaaaagctatctatggcgatgaaaatcctttggtcttaactgagaaaggcgatgtggaacatcaaattcattgggatccacgcatttttaaccgcacttatatgtacagtggttaccgtcagcaaaaagattacgtaaccgaatggattgtaccggaggggcaatattttgtgttgggtgacaaccgagatcagagtgcagatggtcgtttttggggtttcgttccggaaaaaaatattgtgggtaaagctgaatttatttggttgagtcttgataaaaaacaagatgaatttccaaaaggcattcgtttctcaagaatgtttacctcaattaaatgacaaattattgacttaataaaacgccctttaaattaaagggcgtttctgtgttatgaaaaatccggtaaaagtgcggtagtttagtcgcaaaaaataatatgcctttcttttattttcaaatagattaaataggggtattatgttccattattttttatgtggaacatcaaatttacgtttcttattgatattcttgaaaaaaattatgcaactggaaaaattacaaaaaaaattaggtcaccaatttactaatcttgattatcttaaacaagcattaacgcatcgaagtgctgctgcatttaataatgaacgtttggaatttctaggtgattccattctaaattttgctattggcaaagcactttacgaaaaatttcctaagtctaatgaaggtgaattaagccggatgcgtgcaacgttggttaaagaacaaactttagctgttgtggctcgccaagttgaattgggtgattacttaaaactaggtgccggagagttaaagagcggtggatttcgccgagaatctattctatctgattgtgttgaagcgttaattgcagcgatttatttagatgcaggaatcgatgttgctttagctcgagtttatcagtggtatcaggaattacttgaacaaataaaaccaggagaggcacaaaaagatcccaaaacacgcctgcaagagtttttgcaagggcatcgcttaaaacttcctgaatatgaagtgatagaaattaagggagatgctcacaatcagtcttttagagtgagctgtaaagtggaaacacttactgacgtcgtttttggacaagggactagtcgccgtaaagcggaacaacatgctgctcaacaagctattgaaaaattgaaaattaaataactatacccgtcgggacaacatttttttgtccttgcataatatgagagaaaaaatgacagaacaagaaacttattgtggttttatcgccattgttggacgtccaaatgtgggtaaatccactttattaaataaaatcttaggacagaaaatttccattacttcacgtaaagcacaaacaacaaggcatcgtatagtcggtattcacactgaaggtgtttatcaagcggtttacgtagatacaccggggttacatattgaagaaaaacgtgcgattaatcgcttgatgaatagagcagcgagtagtgcaattggcgatgttgatctgataatttttgtggttgatggcacacactggaatgacgatgatgagatggtgttgaataaattacgtcgtgcaaaagcacctgtcgtgttagcaataaataaagtggataacattaaaaataaagatgaacttttaccttttattacagacgttagtcaaaagttggagtttaaagaaattatcccaatttctgctcagcgaggtaataatattcacaatttagaaaaaatagtccgcacttctttacgtaaaggggtacaccattttccggaagattatgtaacagatcgctcacaacgctttatggcatctgaaattattcgggagaaattaatgcgttttacaggggaagaattaccctactccgtaacggtggaaattgagcaatttaaacttaatgagcgtggtatttacgaaattaatggcttaattttggttgaacgtgaaggacagaaaaaaatggttatcggggcgaaaggacaaaaattaaaaactatcggtactgaagctcgtcaagacatggaacgtttatttgataataaagttcatcttgaactatgggtaaaagttaaatccggctgggctgatgatgagcgtgcattacgcagtttaggttatatagacgaataaaataaaacattaaggagacaaattatgtacttggaacaagtgaaaactgagttatttgaagcacaagatgtactaaataaatttatcagtaacgaacaaaatatcaagctcattcaacaagccgcattactgatttcggatagttttaaacaacacggtaaggtattatcttgtggtaatggtggttcacattgtgatgcaatgcattttgcagaggaactaacgggacgctatcgtgaaaatcgtccggggtatccggcgatagcaatctcagatgttagccatttaagctgtgtaagcaatgattttggctatgaacatgtattttctcgttatgtagaggctgttgggcaaaagggcgatgtattattaggcatatcaacctcaggtaactcaaaaaatgtattaaatgctattgaagcggcaaaagccaaaggtatgaaagtgattgccctgacggggaaagatggtggaaaaatggcgggacttgcggatgtggaaattcgtgtacctcatttccgttttgcagatcgtattcaagaaattcatattaaagttattcatattttaatcatgttaattgaatttgagatggctaaaattagacagtaattttttaacctttttgtactattacagagaaagattttatgtcatattacaataatgcaatcttccctttgcttttagtgtaaatttagattaaaatcgcaacccttgttttagggtcaataattcgtttattgaacaatattaaattttgcaaaatattaattaatcattgaggtgatggcttatgccagtaattaaagtacgtgaaaacgaatcattcgacgttgcattacgtcgtttcaaacgctcttgtgaaaaagcaggcatcttagcagaagtccgcagtcgtgaattttatgaaaaaccgacaactattcgcaaacgtgaaaatgcaacgcgtgctaaacgtcatgcgaaacgtgtggctcgtgaaaatgcacgtaatacacgtttgtactaattaaaaaatttttttaattaaactcgagttaaacagaccgtgaaacctcataggaatcacggttttgtttcttttataaattctctatcatatttgcttttatagtattattaggctagtttattcctatttgatgctattttagggattcatcttttttatgtcaggcaaaataccgcattcatttattgatgatattttagctagaacagatattgtagatctgattgattctagggttaaactcaaaaaacaagggcgagattatcaagcctgttgcccttttcatcatgaaaaaacaccttcttttacggtgagtccgaaaaaacagttttatcactgttttggttgccacgcacatggaaatgcgatctcatttttaatggaatatgataagttagaatttgttgaggcaatcgaagaactggcttctttgcatggtttagaagtcccgagagagaaatctacgcttgatgaaaaaacacgagttagttttaaaactaaacgcaatctgtacgaactaatgcaagaaattgcaaaattctatcaagagcaattaacgcaaaatatccccgcacagaattatttacaacagcgtggtttatcaatagaaattattcaacgttttcaaatcggcttttctccacagcaatctagtttttttataaaaaaatttgccacaaatagagaagaaattcagaaattatttgatgtgggaatggtaaataaacgagagagcggtgaattatttgatcgttttcgtcagcgagttacttttcctattcgagatagaagagggagagttattgcttttggggggcgaattattacccaaagtgataacagaccgaaatacttaaactctcctgagagcgtaacttatcataaaggttatgaactttatggtttatttgaagcgttacaaattaatgatagtcctgaaatgttggttatcgttgaaggctatatggatgttgtcgctttagcacaattcggcgttgactatgctgtggcatctttagggacagcaactactactgagcaattacaattagcctttcgttcaacagaacaaattatttgttgttatgacggtgacagagcaggaagagatgcggcttggcgtgctttagaaaatgcacttcctttattggaagatggtaggcaattaaaatttatttttttaccggaaaaagaagatcctgatagttttattcgacaatatggcaaagaaggatttgaggattatattcatcaagcacaatcattaagtgaatttttatttaatactttaagtgctaaagttgatttttcctcaacagaaggaaaagccaaattagcttctcttgcaattcctttaattcagaaagtgccgggagaaatgttgcgattgtctttacgtgatatgttcggtcaaaaagtaggcatatttaatccggacaagttagatagattactatccaatcaacaacaggttgaatataaacaaaaaattccgaaaacagtaaaaagaacaccgatgcgagttttaatcgcacttttattacaaaacacaaatttagctaaaattgtccctgatttatctccactaaaagttttacaagagccgggcttggatttatttgaaaaaattgtaatactttgtcgtgaaaatgttggtatacgagctggacaaattttggaacattggcgagacacggaatatagccaagcacttgaaattttagctacgtgggagcatgctgttgatgatgataaaattgagcaagaatttagagaaaccttgattcatctttacaagcagttagtcgataagcgtattgaagaattaattggtcaagaacgtatggttggcttaactaatgatgaaaagatagaattagcacaattattatcgaaaaagcaagaaaagaaatagttaatcttttataagaatggtagaattctccattcttcaatccttattaatcgaggcagatattaaatggaacaaaataaacaatctcagctgaaattgttaattgcacgaggtaaagaacaaggttatttaacttatgccgaagtgaatgatcatcttcctgaagatcttgttgatgctgatcaaattgaagatgtgattcaaatgatcaatgatatgggtattcaagtacttgaaagtgtgcctgatgctgatgacttgatgctcaatgaaaatattacagatgaggatgctgttgaggaagcgactcaagtattatcaagtgtagaggcagagttaggaagaacaacagatcctgtgcgtatgtatatgcgtgaaatgggaagtgttgaacttcttacgcgtgaaggcgaaatcgatattgcaaaacgcatcgaagaagggattaatgaagtacaaagtgccgtagccgcttatcctaaagcactcaattatcttctagaacagtatactttagttgaagaaggcggtatgcggttggctgatctcattaccggttttgttgatccaaatgcggttgttgaagaagagataattgaagccgacgacatacttacagaagatgatgaagaacatgtagaaagcaatgttgatgtaaacgatgaagaagaggaagaagatagcgaagataatagcaatgtagactctgattcggataacacaattgccccagaagttgctcgtgagaaatttgaagcactaagaatacaacaccaaaaaaccttagccgcaatagaaaaatatggtcgttcccgtaaacaagcaaaagatcatattcaagcattagccgatatttttactcagttccgtttagtgcctaaacagttcgatgcgttggtcaattatatgcgtgatatgatgaaatctgttcgtcagcatgaacgacaaattcaaaagctggtagttgatttggctaaaatgccaaaagaaaatttccaaaaattatttattggtaatgaaagttcagagggttggctggataaattactgcttgcaagaaaaccttggtctgaaagattaatacaacatgaaagtgcggttcgtcaaagcataaaccaattattaaaaattgaacaggaaaccaatttaactatttctcaaattcgtgaaatttgtgacaaagtggcacaaggagaattaaaagctcgccgtgcaaaaaaagaaatggttgaagcaaatttacgtttggttatttcaattgcgaagaaatacactaaccgtggattgcaattccttgatctcattcaagaagggaatattggtttaatgaaagcggtagataaatttgaataccggcggggttataaattttcaacctatgcaacttggtggatacgtcaagcgattacacgctctattgcagatcaagcaagaacgatccgcattccagtgcatatgattgaaactatcaataaattaaaccgcatttctcgtcaaatgttacaaaaaatggggcgtgaagccacatctgaagaattagctgaacgaatgggaatgcctgaggataaaattcgtaaagtattaaaaatcgcaaaagagcctatctctatggaaacgcctatcggtgatgacgatgattcccatttaggtgattttattgaagacaatacgttagagctaccgttagattctgcgacagcccaaagtttgcgtgctgcaacgcatgaagtgttggaaggactaaccccaagagaagcaaaagtcttgcgtatgcgttttggtattgatatgaatacagatcataccttggaagaagtcgggaaacaatttgatgtaactcgtgaacgtattcgtcaaattgaagctaaagcattgcgtaaattgcgtcatccaagtcgttctgaaaccctacgcagtttcttagatgagtaaatgatgagattaaagaaagttatcacgttcttttctcaaacattttggcacgacaaataatcaaaattaacctaaaaaatataatccctattgaaagaaatggctcaatagggatttttcgttatgctaaaaagtgcggtgattattcaatcctatttgagcatcaaacatttctaattgttcgcctcaattaagttaggataaaaagtaaaaaaatcgtttctttcctataaaaatttaggataaaataacgagaattttcacttgacaaataaaatagaacaggaaaaatgacagtctacagtctacagtctacagtctacagtctacagtctacagtctacagtctacagtctacagtctagtatattgcctaaaatcaaccttgcaaggtaaatttgttaggttggacatgttcaaacaatatcttaaaaatcacctatttcaacctcaacctttcggcgaaagtattattcgcctttttctgctatgccttaaaaagcaaggcatcgcctatttaggtttataacctatctctctaaagtttaataaataatcagtaagagataataaataaacaataacagattcgatcaataaccacttaataagtaattaacagataatttttaaagcgagtaaagaatatgaacaaaatcttcaaaaccaaatacgatgtaaccactggacaagccaaagtggtgtctgaattggcaagcaatcgccaaatagcgagcagttcgaagagtaaaccgaagtgcggtgcgttttggggtaattttttaggcatttttaaattttcaccgttggcgttgttgatgttggggatgcttggtgtgagcagtgtttcatatgctgatatagtatatatagatatggaagcaactacaggtgctgctggagtaagagaaaaatgggatttgtcaagttattggaaaaatattggacgtgaaaatattttaatagcacctgttcaacctaatagaaataatcaaaatttaaataggtatggtagtagaataaatacaaatgtacaaaaatctgtaatcataggtcctatggcggcaggtagagatgagcaagttggtatgactgtattaggtcatggtgcagtcggttayagtagtcaaacaactgcgatwgggaataatgtytatrctggwggmgrrcaagcyacagcgataggwtcagatgttatggcagcwggytaygcttckattgcyataggtaatgatgatatcttgagccaaggtggatacgccgacgcattaccgcaagatcttattatgaaaatttatgggtatgatggaaatcataacggaaaaactacttataaggacatattagacagagatatatttgtagataaatatgggaaaaaacctactcaagatcatagacactattctccaacttattcagccggaataggtgcaatagctattggttcaagatcggttgcttatggggatacttcacttgctttagggactttatcatttgctttagctaaaggctcaaccgctgttggtgttcgtgcttttgttagccaagatgcagatggaggtgttgcgataggagatcaatcaagggtatttgctactaactcatttgctataggaaacgaatctgaatcaacaaacaaaggtgctttatcatacggttcaggagcaaaagcggtgggaacgggttctgtagcaataggcaccaaagtagcctctaatgctaagataaatgaggcttcagctagaaggtttagagacaagcttatgcaagaactaggtattggaactattcgggaagataaacaaaaagaatttcatacaagaataacaactgaagttaaagatttaaaaactggaagcgataataatcttgttcaagccggattttctgatcatttagacgatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaatcagtaaaaaagaaagagagagagggaaatcacgctgtaactgtgggttactataccgcaaatagtggagataataccgtagccataggcacagcttcctatgtaaaaggtcaaaattctgtcgttttaggagctttgaacaatgtcgggaaatatgcaagtaatgcggtagcgattggggttggaacaaatgtacataaagaaaactcaatcgctttaggaacgggaacaacagtaacaggtgcgggcgttgtggctatcggttccggcgttggtgtaacaaaagacaatacaatagctgtgggttatggagcagtaggagaatcaagcgaaagtattatcttaggaaatgaagcaaagataaaaaaaccatcaaaaagatctatagttatcggtaatagtgcaaaagttgaaaannnnnnnnnnnnnnnnnnnnnnnnnnnnnnnnnnnnnnnnnnnnnnnnnnnnnnnnnnnnnnnnnnnnnnnnagaactggaaatgtccgctattgctatagggacaagttcatctgtttatgctacaaagggcgtggcattaggggataacgcaagtattggaaaagatgctagtagttcaatagctttaggtaataataccgaagcagatatgatgaactcggtggcgttgggttatcaatccacaacaaagtatttttatnnnnnnnnnnnnnnnnnnnnnnnnnnnnnnnnnnnnnnnnnnnnnnnnnnnnnnnnnnnnnnnnnnnnnnnnnnntatgtaccggaaggatcaagttataaaattgcaaacgataacgccgttgggataatttctgtcggtggatgggataannnnnnnnnnnnnnnnnnnnnnnnnnnnnnnnnaaaaagtgcggtcggtttacgymgtatwrttaaygtckcaccgggtgcattggaytntgangtkgcgacygtaggrcaattaaargctktgcagtayaymaawaaagaagggntagtngtttattacacagttaaagatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtcttggttggggcaaaaggattgaatgaacgcattggttcgcaagatctcggtgamaaaatccgyttygggcatttagcsrawggsgagattwmakmrrtttcygatcaggcgattactggggcacaacttgatgatcttaaaggtaagttggggttgacggtaaataaagatgatccaacaaaatttgataaagtccaatttgatgcagtaaatgtaaccgattcaagtgatacatcaggagtaataacaacttttgaagatgctatccgtaaaagtattgcagctatcaatagaggctataaatttgatgatggaactaataatcctaatactaaagatacacctttttatttaggttcaaccattgtaatcaaagcaggggatgttacaaagtcaggtacaacgacagagaactatctaggcaaaaacctaaaaacagaatttaaaaacgatagttcaaaagcgacattcaccatcggcttgaaagacgatcctgaatttaatactgtaaannnnnnnnnnnnnnnnnnnnnnnnnnnnnnnnnnnnnaaacttgccgtcaacaaagagtatgtggataacaaacttcaaaaygtytcgacsaatttrcattwyttatcagtamaagggacggakcaaggmactggttcaaattacaataacgayggrgcaaaagsmamtyattctgttgctattggggtgaannnnnnnnnnnnnnnnnnnnnnnnnnctggtatagcsataggatataacgctaaatctgaagcagaaaatgcggttgttataggtagagatgtaagtattgatgtaccgaattcttttgttatggggtctaataatacagttacgcaaagctttaaagagacaaatggtgcggttgttgtgatcggtagcggaacaaaattagtagaatcaaaaagttctatcgctatcggtgcggtgtatgtaaaaggtaaaaacggagcagatggcactttaattgaaaacgctgcttggacagcctctatcgggaataaaaacaaaatcaaaaacggtacggatattgtggcgttaggtaataatatccaagcattggataagacagatgaaatgtctagtaatggaacaaagaatgcgaatacagatttaattctgattggtaatggagcgacagctgaaaccgcaaaagaaagtgtgcttattggggcaaaatcaaaagctgaaacgggtgcaaaaagtgcggtaattatcggtcatagtgctaaagctgagagagacgccgtcggtgcagtagcgattgggcaaggtgcaacagtaaaaaccgccgccggcaactccattgccttggggcaagggtcagaagcgactaaaaaagaaaccgcacttcatgaagctaaaatagagactattaatgttaaatttaatttcaaaggtggagtgagtgctgatgataaagaaaacaataaaaaatccgttttcagcctaggcaataaaggcaaggaaagacaaatcaaacacgtcgccgcaggtgcggtagataaaaattcaaccgacgctatcaacggaagccaactttacgctgtcgccgatgaattttcaaaattagcggtgaatgtattgggtgcggaggcagaymtaacgagcggatttaaaaaatcarrwtttgaygtkgytaaatatmakggrartacaaatacwcmarcaymaaaagaaatgacctttaaagaggcaatyggtcaaaatacaacagcgattaataaaggctttatttttggaagcgaagatgatgctaaaggaacgcattacttaggcgataaattgatcatcaaagcgggagcnnnnnnnnnnnnnnnnnnnnnnnnnnnnnnnnnnnnnnnnnnnnnnnnnnnnnnnnnnnnnnnnnnnnnnnnnnnnnnnnnnnnnntattaataggaataaaagataaaccttcttttaaaagtgtattaattacagaagaaattcctgaggatacgtcagctgctcctaagaaarrtamttatgataasyaygctgtcaacaaaaaatatttagacaaaagattagaaaaagtcgccgctaatttcacggttaagggggataatyctaaagatggaaaaggttataccttagataaagagcataatgaattaaatattaacggagatagtgaaaatatcacaaccgcagttgttgataataaaggaataaaaatatctcttaacaaagaattaaaaggtattacttcaattgctaataatgatacaaaaattgaattaaacaatggaactggtggaaatggaacaaaatctatcgttttcaccgctggaaattcagataagaaagtaacattaactgaagataaattcagtggtgtgtctgaaattagcagtaaagacagtcaatctaaattaatacttggtgctgataaagcaactgtagaattagaacatggcaaatcaaaacttgaactaaaagatactgaagcaacaattacagcaggaactgatgctggaagtattaaaattaacaataacggtaataagaaaatcgagttaagccctgaaagtggagcgacattaacacttgcaaaagataacagctctagcaatgttaaagctaccggtttatcgactgttgggttaagtgatgataacgctnnnnnnnnnnnnnnnnnnnnnnnnnnnnnnnnngagttgaacgtaggcactaatacaacctataaattcactgacagcggattagatttagctggcaaaccaatcacaaatctaggaagtgggttagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaggcttgacctttgccggaaatacaggtagtgaatttactcgtgagcttggttcgacggtaacaattaaaggcgacggaatggatctaacatcaaaagccgaaaatgatgctattacctttactttaaataaagcaacttctgtagataaagatgacgaaaaagtcgttacctcaaaagccgtagcnnatgngttgaaaaantatacsaaractactgayttagttgataagttaggcacggcgtatttaaaagtagatggctcgaatattgnnnnnnnnnnnnnnnnaaaaacattcggtrgcaatgtcggtattgctgaaatcaagttagatggtgaaaaaagcagcactgaattagtacaggcggatgcggttatcaagtatctaaaaggtamaggaactaactctgtgaaaatctctgattcaccaaaaactaaagcagagggcgatagttcgataagtataggtttagaagctattacaaaaaattcttattccattgcgattggctataacacaagtgctacaaatcgcaaatcattggtgttaggtagtgatagtaccgtggacggcgaagagtctgtggcaatcggttcaacgaataccgtgagtagtaaatattcaggggtattaggaaaaacaaatacggttagcagagagcattcctatgttgtgggtgcttataatgacatcaaaggcgaacacacctatgtcttgggttcaaatattacgacaactaaagatataacaaatgctgtcattttaggcaataaatcaaaagctgtatcagatgcggtatcagtgggtagcgatrmtaaacaaagacgaattgtttatgtygcmrmwccaamtratmaataygatgcsgtkaataarcaatatgtcgatgcacttggattaaaattcaaaggtaatgatgataaaaatatacacagaaaattatcagaaacattagaaatagttggtaagggattaaataaaaaccaaactactaaatttaatggcacaaatggaaatattgcggttataaataataagcaaaataaattggaaatatcattaaatagagatttaaaaggaattaaatctattagtgatagcaagaataaaaatatagctactgaaataagattcaatagaaaaaatgacacaaacagtatttctaatagtttgataacgaacctaactatttcttcaaatggaggcacatttgaatttaatagaacaggtttgcatatcaacaataaacaaattacagggttaagaagtggactattagaaaaacataatggacaagatggagaaagaaaagatttagactatttaataggaaaagactttgataaatcatcgattaaaactcatgcagtcaatgttggagatttagcgaaaatttctaaggaaatagttgaaaaaggatataagtataaagctgatattccgtcaaataatagcaatgataccagcataaaactaggctcaaccatatctattgttaaatggacagacacaccggcatcagggactggacaaccagcagtaactgttggcacaggaacaacttctcaaacatcagctgttaagtacacaggagataatttaacaactcgatatacctatgtcggtggcaacgctaagatagaaattggatttaacgaaagtcctacatttaaagctgttatgcttgatgaagatcaaacatataatggcggaaatgtaggtgatagcaaagaactcatcactaaaggttaccttgaaaaagcgttagatagctttaaattcaatgtggcgaatggtgatggtaagcctatagaaattggtcgyrrcgayacsttgaaatttaatgctggcttgaatattcaattaacgttagctaaagagggcgaaaaaccggcaaatggtacaacgtctaccattaattcaagtgcggtaacttctaccccagctccgaccgctccagccgtggcaagtagttcagacagttctgaaccagcaagcacgtcatcaggtagtgcaggtggtgcggttgcgtcaggtggtayaaatggcgatagtgcagatacwgyggtcgcttcaagctctccaactgcgggaacttcaagcacaacaacgaccacgccaagcgatacgagtacaccaaccactactaccccaacaacggcagtggtaaccattggcacgamwrakgatttrammaatatcacctcgatttcctctaaagctggaagtgcggrcggaaatgrtgcaaatggytcaactggagamgtgactaaacttaccttagatcccactgatggggcgactttccaagtgggtagtcaaggtgcgaaagtgaatatyratracrakggtattgcactsaygccacaaggggcgaatggtgcagatggggcgaataatccaaatgctgaatcgccatctattactattaamgcaggtrcaaaaccrgyggatmmaaayagyytagaatcgtttgagaaagrtcaagrwccwtctattrcgttytcmacmaarrawactgayggyaakaaaatcggctcaggcaaaatcaccggtcttgctgatattaaaccggaggaaacagacggcacccttgcagcgaataaaaactatgtggatgaaaaagtatccgacttaaacaataatcgcccgtttgatttttatttaggcaatgaaaaagtcgtgaaaggggctgatggcagtttccacaaagacggtaaacctagtgaaaaactttctgaggaagagaagaaacaagtcgtgattaaagccgaaccaagcaccgcacctatcgggattagcaatgtggcgagtggtttgggattannnnnnnnnnnnnnnnnnnnnnnnnnnnnnnnnnnnnnnnnnnnnnnnnnnnnnnnnnnnnnnaaagctgttgaggaaaaagtaaaagcggtgggtgagaaagctaaagcactttcggacaaagcacaaactttcacggatttagcgttagcggtaagtagcttagaacaggcgataaatgcgttgccagcgggcgaggataaaacgcaagcagaagctaagctaaaagaaagcaaagaaaaacttgaagcggttaaaaaagagcttgaaacagcaaaaactgatttggctgatgctcaaaaaggcttaacagaagcgaataaagcctatgaagctaattataagggctatgcaaaagtcgctgacttagtcagtgccgatagtaaagccgaattaaccaacgtagccacaaccggcgatttgcaagcggtggcaaaatctggcatgaagtttaaaggcaatgannnnnnnnnnnnnnnnnnnnnnnnnnnnnnnnnnnnnnnnatcacaggcgagggcgacacgtttaacagcaacctcaccgccgccggcaatatcaaagtggaaatgtcccaagacggcaaaggcttagaagttaaattgtccgataagctacaaaacatgacttcgtttgaaactcgtgaagtgaacgataagaaagcccgcttggatagcaacggtttgagtgtggaaaatacaagcacaaaagaacgctctcatttaagcgaaaaccgtttagcgttctttaaagatggagcgttaggattgaatttagatggtaaagagcgagccttaaaagtgggtgaaaaagcgattattagcattaacaaaaacaatgaggctttagttgaagatctcaacgcttctagctcaggtcaggcaattgcgaataaaaactatgtggacgcaaaaaataatgaattgcgtacacagcttcatagtgttaatcgtgaatcacgttcaggaattgctggtgcaaatgcggcagctgcgttgccaatgattgcgatgccgggtaaatcagcacttgctgtctctgcgggggcttataaggggcaaagtgcggtggctttgggctactctcgtatgagcgataacggtaagattatgttgaaactacacggcaacagcacctcaaccggcgattttggtggcggtgtcggtattggctgggcatggtaagtaacgccctttgagctaaaaaagcagtgaatgatgatctgttccttaatcagttggttgtttagtccaacttttgggtgcagatcggaatcactgcttttttgatgcggatttactatgatactttttaatggtgatggaactgtaatatcatcaccagcccagtattaggcttaggtgaaagcggttagaatacattaacttctgtccttgaaaaagaaatattcattgagggtgatagaagaaattcactgatgtattaggggagttagtaggaatttcgttttttagagagaggaggacatcaatatatgaaatatwmgtttatttcatratkaatcrgcatataatgtcarcytttcatgttaaataaaggattcgcattatggarttttctgtttatctacaattttttatyggrttratygcsttggtyaatccaattggrgttgttcctatcttttatacswtgacwkcwggtcaaartcgtrytcarcaaartyayactgcyatgattacttgtttttcrattgtmgttattttattgrtcagtttttatttyggtaatttyattttaagytckttcaatatatcsattaattcattcmgaattgcyggmggtattgtcgttgtgatgatmgctttaacyatgattaayggaaaaattggtgatcayaaaatyaayaargaggaacaaaaagaggayttnagtgaaaaagataatatygcwgtsgttccgttagctatgccrattttagcrggtcccggatcaatyagtgctactattgttytwggttctagtcagwrttcatggmkcgaatacytrtattcrtctattacratcgcactttttggtytaacytgytayattttrtttcgttattcagarccrsttatmgaaaaattaggtaaracaggatcaaatgtaatwacaaggattatggggttattgctaatgtctttaggtgtagaaattatyactacyggcttaaaaaatwtaggygtwttttagcttcaaagccatattatccagtaaaaaatacaccgcacttttttatgctaaacattgttttttttcagtataataaaaaacattttttcacaacaatgatggaacaataattatgataaatacaaaatttaatgtaagaacctttcaggggatgattcttgccttgcaagatttttgggcaagcaaaggttgttccgtagttcagccttttgatatggaagtaggtgcggggacatcgcatccaatgacttgtttacgtgctttgggacctgagccgatggcgtttgcctatgtacaaccctcccgacgtccaactgacggtcgttatggtgaaaacccgaaccgtttacagcattattatcaattccaagtggtgatcaaaccctctccggataacattcaagaactttatttagatagcttaaaaatgctcggtttcgatccaacccaaaatgacattcgttttgtagaagataactgggaaaatccaacacttggtgcatggggtttgggctgggaagtatggctgaatggaatggaagtgacacaattcacctacttccaacaggtcggaggcttggaatgtaaaccggtaactggtgaaataacctatggcttagagcgtttggcgatgtatattcaaggtgtggacagcgtatatgatttggtatggtctgacggtgaatttggcaaaactacttatggcgatgtattccatcaaaacgaagtagagcagtctacctataatttcgaatatgcagatgtaaatttcttgttccattgtttcgaacagtacgaaaaagaagctcaatacctaattgatttggaaaaacctcttcctcttcctgcttacgagcgtattttgaaagcggctcatagttttaatctacttgatgcacgcaaagcgatctccgttactgaacgtcaacgctacatcttgcgtattcgtgccttaaccaaaggtgtggcggaagcctattatgccagtcgtgaagcattaggatttccggggtgtaaaaaataatgacaaaaccgattttatatttcgcccactggtgccctgataccgccccctttgtcgcagaacttaaacgtctaggcgtagaatttgacgagtgcgacatcacaaagtgcggtgcaaatcttaaactttttttacgtcttcgtgactaccacccagcctttaatcacgccaaagccaaaggctatataggtattccggcattgttgttagaaggggataaagtggtgttggatttggcagaattagaagggatttnnnnnnnnnnnnnnnnnnnnnnnnnnnnnnnnnnnnnnnnnnnnnnnnnnnnnnnnnnnnnnnnnnnnnnnnnnnnnnnnnaatcaaggagaaaaaatgaaatacgcctttatcgactatgaaaacctgaattcattaggtggtttagcattacaagagtatgatcgaatttttctctttattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatattttatccaatgatcagggctatgatggtatttgtaactttattcaacataaaaaacaggggcggatttgtcatggaacaaacggcaactagaaattttccagtaagattggaaagcttaaaaaacaatattcgtagccgttgcggtttaaataatattgatataaaagaggctgaaaaattggttgttctagtaattgataaattgctttcagaaaaagtaataaaaattgctgataacaaagtaagctatcctaagcgatagcaaagagtgaatttttattatttatgccactttcttttaagaagaaagtggctaaaaatttaaatactcggattgaattttgctatcaaaatgtgatctaacattctgtattacatgaagatctacatcacaattaaaccaagtttattattttgtcatatcgttaggaaaatgatgatgagcataaactggcaaaagcaatatccgccgcttgtaaagtgcggtcaatatctgtgtcagtgtgtgctaatgacatgaaacctgcttcaaatgcagatggtgcaagataaacaccttgttctaacattttgtggaaaaatagattaaacttttcaacatcacattgaattgcttgttggtaagaggtaacttcattttgtgttgtaaagaagatgccaaacattccgcctacataattgactacaagcgggatattatgttgatttgctaagttttttaaacctaatgccaatttttttgtgagcattgctaaacgttgttcgttaccttcttttttcaattcatttaagcatgcgattccggcagacatagcaattggatttcctgataatgttcctgcttgatatacgggacctgtaggtgcaatatattgcataatttcttttttgcctccaaaagcaccaacgggcatacctcctccaatgacttttcctaatgttgttagatcaggtgtcacttcatagtaagattgtgcaccgcctaaggctacacgaaatcctgtcatgacctcatcaataataaatagagaaccatattcattgcaaagttgacgcaagccttgtaaaaaatcctgtttcggaaggatgcagttcatgttacctgcaacaggctcaacgataacgcaggcgatttgatcaggatattgttcaaaagcatttttgacagattgaagattattatattcgcaagtgatggtatgtttagcaaagtcttccggaacaccgggagagcttggttgtcccaaagtcaaagatccggagccggctttgacaagcaaactatccgagtgaccatgataacagccttcaaattttaaaattttatctcttttagtatagcctctagccaaacgaatagctgacatagttgcctctgttcccgaattgaccattctcaccatttcaattgatgggactaattgacaaatcagttccgcaagttcaatttcaagcggtgtaggtgttccaaaacttagcccattttctgctgtttttagtaccgcacttaagattgatgggtggttatgacctaaaatcattggtccccaagaacctacgtagtcaagatattgttttccttctatatcgaaaatatacgcaccgttggctttttctatgaacactggcgttccgcccacacctttaaatgctctaactggagagtttactccgcctggaataacttgttgtgcacgagagaataatgtcgctgaagttgtcatgataaatcctttaatatattgttaaaaacacactttgtattctactgtaaatgaagataaatttataaaaatatttataatacgaggtttttagatgttcttttacattatttattatgcacctaattgctcaacaaattgaattagttggtaaacacattatcgtaagcattattaaggtgcaattcttccttatttcgtaacgaattttgtcattccgttgggttaagagaatgaaaaaagaacgcagagaataaaatcatgaaatgtaatatcactttataaattttattaaaaaaacgtcagtttggataaaaaattatctaataataaaaaaaagtaaaaaaatgctagacaagtaattgtgaaactcttaatatacgccccgcaacgacgcgatgagcgctcgtagctcagttggatagagcgttggcctccggagccaaaggtcgcaggttcaaatcctgtcgagcgtgccaggcgacgttatatcaaatgtggtggctatagctcagttggtagagccccggattgtgattccggttgtcgtgggttcaagtcccattagccaccccaattagtcggcgagtagcgcagcttggtagcgcaactggtttgggaccagtgggtcgtaggttcaaatcctatctcgccgaccatttttgttctttaacaaactatcagacaaactgtgtgggcacttgtgaaactgtattaataagagattaaaagagtaagataagtgcttaaactagagaaattcatagagaaaagatggataaaatagtcagtatttattgagcgaagagattaaattgaagagtttgatcatggctcagattgaacgctggcggcaggcttaacacatgcaagtcgaacggtaacggggagggagattactttctctgctgacgagtggcggacgggtgagtaaagcttgggaatctggcgaatggagggggatagccacgggaaactgtgggtaataccgcgtaatgtctaaggaccaaaggggtgggactgtgaggccacctgccatttgatgagcccaagtgggattaggtagttggtgaggtaagggctcaccaagctgacgatctctagctggtctgagaggatggccagccacactggaactgagacacggtccagactcctacgggaggcagcagtggggaatattgcgcaatggggggaaccctgacgcagccatgccgcgtgaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattgctgggtagctaaatgcgggagagataagtgctgaaagcatctaagcacgaaacttgccttaagatgagttctccctaacgaagagttagtaagggatgtttgagactaagacgtagataggtggggtgtgtaagtgtagtgatatattgagctaacccatactaatttcccgaggggcttaaccatacaatcttgagtgttttgcatagaggaagaagcgggacaggatagagagaggaatacttgaagtagaggcttgtttttttattgaagaagagatagagacgggatataagagagaggaatttaacttggcggcgatagtgcggtgggaccacctgacaccatgccgaactcagaagtgaaacgctgtaacgccgatggtagtgtggggattccccatgtgagagtagggcaccgccaagttttttatgattttattttgttagtttatttatattagtaagctaacaaaataagtttttttgcgactatagctcagttggttagagcaccaccttgacatggtgggggtcactggttcgagtccagctagtcgcaccaaataaataaatcaatgtaacgcatagtaacgcatttcaacccaaaagccttgtacaacaaggcttttttactatccgattaacgctagttgcgtcaggataaatcacattgaccttgaataatagtacccattttagtacccacgcattataattagtttgattattgggtactaaaattatacaacctcttacaaatacacaagtagaaaaggcaaagtatataacaggaaacaaagcagagttaaacgatggtggaggcttatttttacagctatacccatccggctcaaaaatttggagatttcgctataatcacccagtgaaacaaaaaagaacaaagctaactataggtaactatcctgatttttctattgctcaagcaagagcaaaaagagaagagtttaaagcattattagcacaatacatagatccataggcatataacgagcaacatagaacagagcaagaacagagcaaaaaaaggacgcttttagcaattgccgagcaatggaaagataaaagagtgaaagagatagaacctctaacaatggctaaaaattgggagcgattaaataatcattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatcatttatttcctcatttgggggcttacccaatagagaatattacccccccttttttttttactaattaatgctgtcaagcctctttacgagcaaggtaaaaatgacactatgcaccgcattataaatttagttaatcaagtattaaattacgctgttaatttgggtgttttatcatttaatccttgcctacaagctagcaaggaatattacaaagacctcccaaaaaaatcatcctgccatccattattctgaactcaccctattattggctgattttgaacaatctaacagagaggcattaactaaattgttatttaggtggcaattgttatcaatggtacgccctgctgccgaagctgtttcagtggaatggaatgaaattgatttaaataaaaaatttgggttattattcctgaagaaaaaatgaagaaagttagaacggggagattttcgcattctgtacccttatcaagacaaatgacaaaatattttagagcaattgaaaccaataacaggacatcataaatatgtatttccatcattcacaaaacctaatcaagcaatgagtaaagacacaattgctaattcgttgcgtgaaataggctatcaaggtaaacaagacgcccacggattgagggcgattgcaagaacttatttagaagacaatatgattgattttagacttgctgaaagttgtttagctcacaagataggggataaggttagtcaggtctataaccgtgctgactacatcgaacagcgtcgcccagttatgcaactttgggggtatgtgcaccagaattttttaatcaatcaaattgacagtaaaacctagaaaaatcaatgtttctaggttttttatttatcaatatcatatgaatatcgatttattctacttattttggcaatactagcgagaatgatatagtagttgtggtcagtcctctgagtaaagctgagtaaaggtaaaatatgaattattttcataggtttagcaaaaaatctcatttttcttaaaaaatttttatggtttaatacaccattattctaaaaatgagaaaaattaatatgatgacaacatttgaatgccgtgtacatacgcttgaatttgatgaaaattaccaaccagaaatgcagagtacccgtttaacgaccaactttgctaaccttgcacgtggcgaaaaccgcaaagaaaatttgcaaaatgtcattgcaatgattgataagcgttttaacgatttggcaaactgggataatccaactaatgatcgttattctgtgaagttagagatcgtgtcaatagatattgatatggagggaaaaggtaaattttttccagcactcgaatggctgaaaacctatgtcatcgaccataaaactggcaaaaaaattgatggtatcgtaggcaacaatttttcgtctttcgtgcgtgactatgatttcagcgtgttgttgttagagcataacagaaacaaggaagaatttaccgtaccgaaaggctatggtgaattgcatggcaagctattcaaacatctgttaacttcctctgcatataaagaaaaatatagtaagcctccggtgatttgtttaagtgttgcaactactcgtacttaccgcagaaccacaaatgttcatccgattttaggggtggaatatcatcaagataattattctttaactgatgagtattttgcgaaaatggggttatctgtgcgttattttatgccaccaaaatctgttgcaccttatgcgttttattttgatagtaattcagatttattgaatgattacaccaatcttgaattgattagtacaattgctacaatggaagctttccagaaaatctaccgtccagaaatttacaatgctaattctgtggctggtcaagtgtataaaggtagcttgacttatcaagattactctgtgatcaaagtagaatatgatcgtgttgagcgtacacagcttgcaatcaaacaaggtaaatatactgaagcacattttattaagccatataaagcaattttagatgcttggatggctgaaaaataaatcaagacagtatttttatttgatacattcgtagggtgggttaaattccgcccctacacatttatttaggaaaaccaaaatgagcaaaattcttctcccaacctctacagctggtagtcttccaaaaccggtgtggcttgctgaacctgaaaaactttggtctgaatggaaatgtcagggcgatgaactttttcaagctaaaagagatgcactattagtttcccttgctgaacaagttgcagcagggattgatattatcagcgatggtgaacaaactcgtcagcactttgtgactacatttattgagcatttagagggcgtagatttcaataagcgtaaaacagtgcgtatccgtaaccgctatgatgcaaatgtaccaagcgtaattggtgaagtttctcgtccaagctccatatttgtagacgatgcaaaattcttacgcaagcatactgataagccgattaaatgggcattacctggtccaatgacaatgatagatacattatatgatgcacattacaaaagtcgtgaaaagttagcatgggaatttgccaaaattttaaatgaagaagcgaaagagctggaagcagcaggtgtagacattattcagtttgacgaacccgcgttcaatgtattctttgacgaattgaatgattggggcgtggcagcattggaacgtgcagcggaaggattaaaatgtgaaactgcggtgcatatttgttacggttatggaattaaagcaaatactgattggaaacagactctcggcagtgaatggcgacaatatgaagaaagcttcccgaaattgcaacaatcgaaaattgacattatttctttagagtgccaaaattcttgtgtacctatggaactgattgagctggtgagaggtaaaaaagtgatgcttggtgcgattgatgtagcaaccaatattatagaaacacctgaacaggtagcggatattttgcgtaaagcactacaatttgtagacgcaaaaaatctttatccttgtactaactgcggtatggcaccgctctcacgtcaagttgcaaacagtaagctcaatgcgttaagtcaaggtgcggcaattattcgagcagaattagcaggttaatctgatatggtagaagtctctcaatttaaagatgcaatggcacaacttgcctcagcagttcatattgtgaccacaagtggtgaaacagggcagcatggttttacagcatcagccgtttgtagcgtgactgactccccacctaccttgcttgtttgtataaatagcaatgcacgtgcctatgagcattttataaaaaatcgagtgctaatggtgaatactttgactgccgaacaatcttctttatcaaatatattcgcctcaccattaagtcaagaagaacgtttttccaacgcttcttggacaacgttgactacaggatcaccgatgttacaggatgctctgattaattttgattgcgaaattacagaaattaagcacgttggcactcacgatattttaatttgtaaaattgtagatattagacaaagtgataagaaagaagcattggtatatcacaaccgctcttaccatattcttaaatgaaatttgtaaataaatcataagtcttaaaccgtaacttataagtcgataagttacggtgttaatttgaaaaaagagttatgattttattaactttcttagaaaatatttgagtctattgtatgtacgtctataaaataattgttctcttttttgatgtttaaccaatagttgactgttatttagttccttttctaatagatctagtgagaagagttggcaactttgttctaaatattgcattgcttccaacttatactgccttcttctatttagcttgaaatcagacaatgtagtatttggcatttgagtataagataatattttatgtaaagggattaattctaaattgaataaaaatgagatagttttgggcaaataaacagaatgtttattttgttgtaattcatagttaccaatcccaaaatctgctttcataaattttaagtgataataggcgaaaatattttttctcatatttctttgactgatgtctaaaaattctgtttccttgttttttttaaaaatgctatcttcatctaccctaaataaacatagatcaccatataatccacaataaggcgagctgtaagaaatataaagttcaccacaatgatcaataatattaattcctgaaacaggcaatacatcattgggataattttcttttaagtctagataagtctgttttagcaaaggtattttttctgcacaaagaattaaatctccgtctatttttatagcccattttttcgtagtttgactcaatgaaaagttatagtaattaaccaaactatggggattattaggttctaaatttttatagttatcactaccttgaggataaacaataggtaaatagtgaaaagtttttattttattaggataaagttttgcgtattgttcagcaatttcagcagtgttgtcttggcaattattatagacaatcaccaattcgtctaataaaggaagccagctttcaatagattgagcaagaaactctccttcattacgtaatcgcataaaaccgcttaagccttcagaacgagtgttggcttgaaaacgtgaaaaatcaatggtaggatttttgactgactgactgactgactgactgactgactgactgactgactgactgactgactgactgactgactgactgactgactgactgactgactgactgactgactgactgactgatttagcatattgttatttccggtctttttagagagaaaaatggtggagaatttccaccatttttcaatattattcacttctagtgactttaatcgccaactcttccaaagctttttcattagcaagactcggtgcgtcagtcattaaacaagctgcggctgttgttttcgggaatgcgataacatcacgaatattatctgttccggttaacaacatcgttaaacgatctaagccgaatgctaaacctgcatgtggaggcgtgccgaattttaaggcatcaagtaagaatccaaatttctcacgctgttgatcttcatcaatgcctaaaatatgaaatacagtttgttgcatttttggatcgaaaatacgcactgagccaccacctacttcataaccattaatgaccatatcataggcgtttgccaccgcacttgtcggatttgcttctaattgctccggtgtgaaatcttttggactagtgaacggatggtgcattgcagctaaattaccttcttcatcacgttcaaacattgggaaatcaataacccaaagaggtttccactcatctaagtgagttaaacctaaatcacgacctagtttcaatcgtaacgctcccattgcgtcagtagcggtttgccatttgtccgctccaaagaacaaaatatcaccgctttgggcagaagtgcggtcaaaaattgctttgattttttctgtcgttaagaattttccaattggactttgtatgccttctaatccagcgttgatgtcattaatttttacccaagctaaccctttcgcaccgtaaataccgacaaattgagtatattcgtcaatttgttttcgagtgatatttataccgtttggtacacggatgacagccacacgaccgttcgagctatttgcagggtcgctgaaaacgttgaaatctatatctttcacaatatcagctacatcgactatttctaatggattacgtaaatccggtttatctgaaccaaagcgttccattgcctcttgccaagtcattgtcggaaatttgcctaaatcaacgcctatggtatttagccataaaccatgcaccattttttccataatttcacgcacttccggtgcagtcataaaggaagtttccacatcaatttgagtaaattccggctgacgatctgcacgcaaatcttcatcacggaaacacttcacaatttggtaatagcgatcaaaaccggacatcatcaatagttgcttaaacaactgtggtgattgcggcaaagcataaaacttgcctttatgtactcgacttggaactaaatagtctcgtgcaccttcaggcgtagccttggtaagcattggggtttcaatgtctaaaaaaccgttttcatccatataacgacgtacaaaagcggtaattttggcacgggtttttaaatgttgagccatttcaggacgacgcaaatcaagataacgatattttaaacgctgttcttctgtattattctgattaaaatctaaaggaagtacatccgaaacgttataaacagacaatgctttagctacaacttccacctcgcccgtcgccatatttttattaatttgattatccggacgagcaataacctcaccttcgattttaatacaaaattcattacgcaatgcactggcttccgtcaatgcttcttgatatttcggatcaaaacaaacttgtacaataccttcacgatcacgcatatcaataaaaattaaaccgcctagatcacgacgtttatgaacccatccgcttaatattacttgttgtccaatatggctacggttcaatgcaccgcaataatgagaacgcatcataatgacttcctttatatctgaaactactgaaattagtcgacgaattatagctgaaatctcgcttatattgaaagagtggacggaatttatttgagtgagacttaaacttcttctaaaatgaccgcacttttttacacttttttagatgaaccataaaataatgaataaagattgtatttttgctgcacccattgaaaaactgggagattttacttttgatgaaaatgtcgctgaagtattccctgatatgatacagcgttctgtccccggatattccaatatcattactgccatcggcatgtttgccgaacgctttgtgacggctaactcgctagtgtatgatctggggtgttctcgtggtgcagccacgttatctgctcgtcgccatatcactcagcctaatgtaaaaattatcggcgtggataattcattaccgatggttgaacgttgtcgtcaacatattaacgcttatcagagtgatattcccgttgaaattttgtgtgatgatattcgtaatattaaaattgaaaatgcatcaatggttattttaaatttcacattacaatttgtaccgcaacaagatcgtcaattattactggaaaaaatatatcagggacttaatcctaacggaggattggttttatcggaaaaatttcgttttgaaaataaaaaaatggacgacttgcttattgatttacaccatcaattcaagcgagccaatggttacagtgaattagaagtaagtcaaaaacgcaccgcacttgagaatgtgatgagaacggatagtatagaaacacataaagaacgcttaaagtcagcaggtttctcccaaatagaactttggtttcaatgttttaattttggctctatggttgcgataaaataacaaaaaaacagcctctgaattaagaggctgactaagtttaactatgactttcataagcgagtagcgtattaaacataagcatcgcaacagtcatcggaccaacacctcccggaactggagtaatgaaactcgcctttttgctcgcttcatcatattgcacgtcaccgactaacttgccatcaactcggttaattccaacatcaataataattgcaccttctttaatccattccccagggataatgtgtggcttacctactgcaacaactagaatatccgcttggtgcacatgacttttcaaatctttagtaaaacgatgagtaacagtaactgtacagccggctaacagtaattccagtgccatagggcgaccaacaatatttgatgctcctacaataacagcatgttgtccgtacagatcaacgcctgtggtttccagtaatttcattatgcccaaaggcgtacaagcacgtaaggttggaatacgctgacaaagacgcccaacattatacggatgaaaaccatcgacatcttttgttggggaaatatgttcaatcactttagtagaattaattttctctggtaatggcaattgcaccaaaataccatcaatttgcggatcttgattgagttgttcgatgagagttaataattcttgttcagttgtttctgccggtaaatcataagattttgaatagataccgagttcctcacaacttctacgtttacttcccacataaacctgagaggcaggatcagcaccaactaaaataacagctagtcccggtgctcttttcccttgttgaagataatgctgaattttttcagcaacattaaatttaatgtttttagagagttcagtacctgaaataatttgtgcgggcattaattctttccttcaaatttgatctcaaatgatcaacataacaatcatttaaattattgaacatgaaaaacgttgctattgtgtcaaaaaaaagcgagaaatgtaagtcaatttgagagaaatttcatcaatcaaataaaaaagtgaaaaagtaattgactgtttatgaaagaaaattataatgcacctcatcggcgagtagcgcagcttggtagcgcaactggtttgggaccagtgggtcgtaggttcaaatcctatctcgccgaccatttttatatttcttattttttaaatgcgcccttagctcagctggatagagcaacggccttctaagccgtaggtcattggttcgaatccaatagggcgtgccatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccatatttcctccaaaaaataaaccctagcggtggctatggttgttttaaataatctactagtcgctccccaatccatcgcattacagggactgccattgagttaccgatagctttataacgtggactatcggggcaatcatcaatcggtttgttgcgatatgggattggtgtccaattatcaggaaaaccctgcaatctctcgcattcggttggagtgagcttgcgaataatagatggttggcaaatgcaaggtacattatttccacctgtccccattcttgcttttaatgttggtgatattggtttatctgcaattcgcacagcctcttcgcctttgacttcgaataacaccttatactgtgatgcagtcattgtaggtgcgataccaattcctacagtgtgatccttgtctttgcaaattattgatggatacgctccataagagcattcaccaatatttttggcagaacttttctcctcttcttggctctgattaaaatcccctcgcaagctcttttgctcaaggagtatttgtgcgacacttcgccttctagcacttgccacaaggaacactcttttacgtcgttgggcaacgccgaagtattgagcattgaggactcgccaacagatagtacgggctgaatgcacataaccagagtttgtccatcttgcccctgatggctgtaatggctgacattcttgagccagtccagccaaaaggtgtccgaatgcgttgtccttggtagataagacaccttgtacattttcccagacgagcacgcaaggcggttgtccattttgatttctgacataatctattgcctctaaaatatggattaaagctaaagttaaatttcctctctcgtcatcaaggctttctcgcttgcccgcaaccgaaaatgcttggcaaggtgtacccccaactaacacgtcaggggctttgatttcacgatttaggattttttcaggcaaggcggtcatatcgcctagatttgggatttcagggtatcgataagcaagtaaagcggacgggaaaggttcaatttcagcaaaccataaaggcttgcctaagccttgccacgccacacttgctgcttcaattcctgaacaaattgagccgtaggtgaacattgttacttcaataaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatatctttgcattcccgaacacatagacgtcgtcacgcacatgagcgtagccacgaacattagcattctctgttatccacgcacagtcacttataatagcgtcttcatagacttctgcgttatctcgtacgtaggtgtcatcacgtacaaccgcgttgtcatataccaaagccttgtcacataccacggcgttaccatgtattctagcgttaccgaatactctcgcattgccatacacttymgcattgtcrkacacccamgcrtyyccgtcrtgacttagattttcctctttctcaatrtaaccgcccagcttacccgcctttatatcaccaaaagagattaatgctttaattcggtagagtgttttaccattctgttgaatagtatcattttgaagaagttcgtattttttttgatcttgtttttcatattaaatttccttgtttgttaacgtcgtttgtcggattaattttttcaatcaactcatttccgaaataagctgatcgtagtatttttgtgcggcacttacgcgttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaattgtgccttgatcactttttctatagcttgttgtcttgtttcgataatatccatcatcgcaccgctcccaagtgcgatatggtaatcttcgctattgtctaactcatcataaaattggctgtaaatttggctgtttggatcttgtagttccatcaaaacttcggtacgcactcgtttaaattccaaactatcctcaatgtcttcaccaaaatatgcttctgccatatggtcaaaatgtctatctaccgcttggattaattgcatatcgttcattttttctttccttttaaaagtagcgtttttaatttttcaatagaggctaagtcaaaggttaatacgctgtgatgtcttgtttggcgatctaacttaatagataaattaccctcttcatcaaattgacaatgttgaaccttgtgtattgttttacctcgctcgctcttgattaccgcacttaaccttggatttttccattcaatagccgtaacgccctgtttctcctgaagcataggtagtttctttatcccttttaattcttttgtcatattgatgatgtcgattgctttgtttgtcgctttaatggcgatgatttcgctcaccatcggcttgcaagtgcggtactctctcacatcatctacccaaacttccccataaaattttttactgattggattttgtaaaatttggattttgtagctattcatcttcatttcccctccttgtcatactgtgcttgtagttgttcggtgtatttttgcatgtagtctacatcggcttgggtaggcggtggcggtatgtcgcccttgcgtgaaatccattcaattcttgccatttcttcatcgtaagcaagttgtgcttcgggggagagttgtccgtattgagcaaacgctgggtgaaaataggcaaagacaagtagagtgctaagaaaaatagccacgataagaacgataaagccaagccatctgtaaaatgagattaataaattattcattttttgtttcctttttggtcaatttactgaatttaggttgagtgaaaccgccacactggaaaagtgcggtcggtttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaataatcagttccccctccaagcagattttatgaacatactccaccgcactttgtaatttatctgctgggatatcttcaatactttccacattcatatagtgatgaacgaggttataggcttcgctgtagagtaagccttttttgctaacgagcatatttacagcattgcgtaagccggtgcgttcattaacagtcgttttgcgttcggctttgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactttctgttgaaagtgggtataccctaaatcaaagggcggtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaagccgttattgaacggcttgtagtgcggtcatcttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaaagtatcttgtatcgttgtagtcttcgtttttggttagagtgttgagttttgtttttattttttacttctaacagtttgtcaattaatggaagcgtgtctttaatcgctttttttgtccaattcaaattcaattctacagagttgaaaatatcgcttatgataatcggtttgatttttttaagtaagaattcaacgctttcagcaaagcgagtgaataacatccatacatcgatcatcttttttagttcactttcagttagttctaaagtgaatttgggttcaggcattggtaatttaagttgtgttgtttggttttccagttggtttaaaaacgcacgcaaaaccacaagatgaaattgtggcgaaatccacgcagcgtaggcgatgacgatttctttgcaggcgtatgtgccaatgccatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtcaataaaaaagcctgtgttgtaaacaggctattttgttattttcttttttgttttctaggtttatcgtatttaatcatttcacgatttgcaccttttagtgttttcttcacttctttaatattctgttcaagttcaagatgttcaggtgcaatcccactattttttatcatcatatcccgaacttctttaccaacttgagaagcggtattttgtaatgcatttaaaccacgtacattcttacttttaattcgttctgctgtttgagttactctaaaccagttacctgcaagttcagtatttcccataaagtcatataaagtccctttttcatcaggcatctgtttatgacgtttaagttcagctaagcccatattatacataccacggaatcccgcatctttaaaaagtccaaagtgttctggtaaaagcccggcacctttcgcagaagctgacataatttgttctccatcagctaattttttacggatttctaaacgctgaatagcgttatcatcaatcgcattttggactaatttatctgcaacagctgccaagattgtttttgcttgagcaacttgttcttttttagaatctgcgtgcattgtgataagaaagcacgcaaaacgagagagtttataacttttcacctctctaccttgaaagacaatgtcaatctgcgagaagttatccattatgtcaatttcaaggttggcacaagacgacatcgctttattgataacgcttttgaatgagttccaagactcgtaaccaagatgtagcataaaatcgtgggcgtgccagtatctaatgccattttggtgagcatcattttcaaagagttctaaatcaaattgttctgccattgtttacccctataaaaaaagccgttattgaacggcttgtagtgcggtcatcttaatccgaattcggggcggtgtcaaataaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccatcggacaataataggttttatccaaattgtatcgagatgaaatgaaagcaccttggggatttttagagtataatggatctaaccttgtgcttgctgatgatgttccggaaaacgttccttaaaattgattttttcatcaaatggaatttcttcgcacagctcaccatcataggtaacttgggacattgtcttgattttttctttggcttcttcggcattgttggcgtatacattacagcatcaacttgtgccttgtagctgatagcgaaaaaggtattttttcattattttttcttccttaggtattccttatgaaatttgaaacttacttagacaaacgccatgagtggcgttggcgtttaaaggcaagtaatggcaaaataattgcagatagcggtgaaggctataagcaacgttctgactgtttgcatgggatttatttggtacgacaaaccaatcagtttacagagattatttgtcttgaagacgataaacattaactccaaagctccgcaaagggcttttatttcatctcgatttttaacgagcgttccttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttattttattgatctgcaaagaaatttatttttgaaaaaaatgattgatcgcttgatttttgaacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcagtttgagttaaagaaaaaaccgccgaggggcggttttgttattgatgctcaataacatcaagaataattgcatctttaattttttcatcaagtattttggcattaatactcagtttaaccggttttctttcccattctgcttgcattagcaataatttgtttttattacccgctaaaaactgatcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgttaatccaaatgagaaacaaagtcaaagtcaaaatgcacgcattttggcgtatatgcaaaagggcgggcggattacttcgttagaagcgttagcacgttttaattgtttgcgtttatctgctcgaattaaggatttacgtgattgtggtcacgaaatccatgcagaatttattgaagtgtctagtggcaaacgtgtgaaacagtattttatggaggcattgcatgagatttagtcaacacttacgacaattgggtcaacctattgcgtattatccaaaaatggcaaaacccttaggcggtgtgactgctgcgattttattttgtcagcttttctattggcaagataaaaccgacaatccgttaggcgtgtacaaaacacaagctgaacttgaacaagaaactggattaagtcgccgtgaacaggaaaccgcacgcaaaaaattagttgaattgggtcttttaatagaaactcacaaacgcttagaacatcgtatttattttaagctggatttagcgaaatttgacgacctaatggctaccatttttgaggtagaaaatccaacattacccgatggcgataatgtacaaccccgaatggcggaaagcgacattcgggaagtagcaaaaccgccattcgttaatacaaagactactacagagaatacaaacaataaaaaagatttaactaacgttaaatccaaaaaagccacaccaaaaccgaccgcacttgctttgcttgctgaatttggcattaccgatcagcttgctgaagattttattgaacagcgtaaagtcaagaaagcaccgattacccaaaccgttcttaaccgcttgcagactcaagccgatattgccaaattgccacttgtggaggtagtggcgattatgattgaccgcaactggactggctttaatgccaattgggattggaggggcgaaagccaattttcaggtaaagccgagccatcaagcaagcctaaattcagcgatgaaaacaccacttggtggcaagggcgaaccattgaaatttatggagatacgctgtgaaaacctttgaaaatgcgaccgcacttattggcagtaacccgaattattctgcacccgtagcacaagggcaaaaacaggaaattcctgagcaagtagcgaagtatgttgaccgattatttgttcgtttaaaagccatttttccgggctggaaagcagcgtttaactctgatgcagagtacgaggaagcgaaggctacttggttgcaagcattggtgaataatgggattaccaaagcagaattatttaaacgtggtttgcagttagcagaacgctcagaaagtccatttttgccgagtgtcgggcaatttattgcttggtgtaaatcaggcaatgagtttgccgatgttggtttgcctagtccagaagagttgttgcaacgctatcacaaatttcgtgcgagttgtgaggagccggagaattatccttggcaaagtgcggcagaatttcacttagtttgtcagttaaaacgggcgatttatcaggagaatttaacccatgagaagttactgaacaaagctcagtcgttgattaaagccatggcaaaatatctcaaagaaggcggtcaattagcagcaccaaaggcaaaaaaattaaccgcaccgaaagagccgaatttaacgcctgatgaatgtacaaaatactttgcagagctacgtaaacaaatgcgtggcatgacaaaaacggtttagcaggagatgataaaatgcgtgttgaaaaaaatgcgtaccgcacacctcgttatgtttttaattggttagaacgtcgtttttattggtttcatttagacggttgtgcgaatgagcataatagcttacgtcatcgttggattggcgaaggtagcagtgttgcaacagattttttagcagatgatttgtttgatcgcttaattgatgaagtggttgaacaagcggaattattacggattttcgttaatccgccatacagtaatcctttgccgtttgtacaacgtgcggttgagttgatgaaagcgggttaccttgttgttatgttgttaccggcggataaatcgactaagtggtacaaagtcattcaggataatgcaacggaagttatcgatattatcggcggtcgaattaactttattcatcctgaaacaggtgaggaagtcaaaggcaataacaaaggctcaatggtggcagtgttcgatccgtttattcaaggatttgtaactcgtcaagtgagcttggattttgtgaaagagtgcggtatttcatagtgagatttttcaatggctaaataccaaatgatgaaacttgcaggaggggtattttctccattgaatgatgctgaggctgaacgcttgaaatcttttcagaataacgagcaatatgaaattgaaattaaaagacagcgtaatccagcatttcatcgtaaggtgtttgcgttttttaatttctgttttgagcattggtgtggtgagcattccgattggaaatttcaagatgaaatagctcaatttgatacgtttcgcaagcatttaactgtattggcagggttttatgttaaaacgtggaatttaaagggtgaggtgcgtattgacgcacaaagtttgagttatgccaatatggagcaagaggaattcgagaaggtgtatcaggcgttgattaatgcggcaattaaacacgttttcaacaacactatagacgagaatgtgattaatcaattgtattcgttcttttaaaattaagatataaaaaaccgcactcgaaagtgcggtgggttttgggcgagtttagcaggctttcagtggcaagcggttttcctgtttgaggcttgccagcattcgtttaattgtcgggttggtttctttgatgttctgcttgcagaggttgtaattaaactgtgcggagcgttcttcaaagcggtcaaaatcgaacccgaaggctttaagcaggaaatacacgctttcttgaaaacgggtgaactgcatccacgtgttgatgaagttgcgtaattcgctttcggtgaagctgaacgtgattgagggttcaggttccggcaaggcaaactgtttcggttttagctgatatttccccgttttacggatttgcggtagcacttcttcaaagacccagttttgaaactcgaccgcttctggtttgtttgagcggaaaatcacacgataaagatttggctcattgataaagatcatttcctgatcaccacttgtggtaggggtggaaagtttttccaccccctgcggattgaatttaaatttgcttacagagcgattgcataagccaagaacagatgcaacatcaagcaaacagaaaaatggttcagaacctaaaacgtgaatacgtactgggaaagatttgaagttgaaggtagagatttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagatttgaagttgaaggtagagatttgagttgtcatnnnnnnnnnnnnnnnnnnnnnnnnnnnnnnnnnnnnnnnnnnnnnnncgagaggttcgaaaacctaaggcaggtcgggattattcccctttcgggtattgtattctccgccctctcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctgtgaaaaatatcctacgcctaacagaggagctkrycaagcgtaggggattgattawgccgataaaatcttatcggcggcaatttgagccaagaaaccgctacggcttttgtactctttatgcgttgccacaaattcatcaatacgcttgatgagataagcaggcattgtgatgttgattttttcggctttgcctaagaggtgagtaatatcaacatcaacgaaaccgaagaacatatcgtactcggtaaagtcgggattattgcggtgattattgattgaggttggtaatggaacttcttcgcccatttcaaccaataattccaaatgccctttgatggcttctttggcgttagcataggcttcttccaaagtatcaccggcagaatggcaacccggaatatcagggacgataacgccgaatgcgtgagtttcatcgcccggttcgattgcgattggatataacattttatgctcctgtatagcagggctatttcagccccgcttgtttaagtattgaatgttccgttcctttttttaaatccttttcaggatgttggacggtaacaatcccttttttggttggatgagtgaagtggtggtggcttcctgttgcgtgatggaatttccagccgtccgcttcaatccgtttaataatttgtttgctactactcacattgctttgctcctctgtattgctaatcaatgtggttattatacctataatttagggtgacgcaataaaaatgtagattatacccacaaattttaatttaagtgatttaaaaatgaacaaataaagtaaaggaggttgaaatggtttgttatacggtgtggataatgatattggctttgataggttgaaaatgattaaaaaagtgcggtcaaaaaaatgcaaggtttgcggaaatgcgtttaaaactaatgatagttttcgacgatggtgtagtcctgaatgcggggtgaaattagctcaaatggcattggtgaaatctcaagaaaaggagaagataaaaagggaaaaggaagaaagagcaaagattaaggcggttaaagagcggttgaaaagtcgatctgagcgtttaaaagagttgcaaggtgtatttaatcgttttattcgcttgcgagataagaatttaccttgtatttcttgtggtcgctatcatcaggggcagtggcacgctggacattatcgtagtgtgggtgcttgccctgaattgcggtttaatgaggacaatgtgcataaacaatgcagtgtatgtaataaccacaaaagcggcaatgtgattgagtaccggattaatttggtggctaaaatcggggtggaaagagtggaatttttggagagaaaagaccatttaccgttaaagctcgcagatgatgagattaagacgttaattcaggtttataaggcgaaggtaagggagttgcaagatgcacaatagtctaaatgattttaagaaaaaatgcagacaatggggatattgggcaacacctagaattggtacggaatatccgagtatatcaccgtcaattccggttccgcaggataaatattgtggtaaagtcgatccaattaatgaagatcttgcaatggagtttgaacgttgtgtgttaattatgcaaaaggtaactcgagaactttacgatgttttcatggtgacttatgtttatcgcttgccgttgaggaatgaatatgacaggcggagaattttggtgagaaaagggatatgtgaaaccttggatataagcgaaaccacttataaaaaatatctttatacggctgaaacctcattaaagcttatgttaagtcaacatcagtgtatttttgttgcataaacctccctcaaggcggtttattcttaccacaaactcacaagctaacttacaagcagcttctcaacaattcgcaaacctatcaaaattagaccgcactttaaaaggctgaaaaaacaaaggggagcctgacgctccccactacacgattaaaccgacttgttatcgcccttgtttaatcgaccaactgtttttcaaattggttttacaagcccctttcgggtacagattggattttactttaattttaatgctaatgcagtacagtttttaatcacttggaaatcagtatcgctaacaagtggcgaaatataatcacgcttaccgattttataacgatctaatcgggaaatcgagacggtataaatcatatcgcatttcgcccagcactgaatgtttgctttatcaggcaatggattgacaggcaaagcatagtgatatttttctaagggttgaggttctgttgtactgagcggaataaccgtgactaattctttattccgtttatgttttgcaatgacgacaacaggacgaactttcgtcatttccggtgattgaaactttgagaaatcacacattagcaccgatttttcttttggttggtattttaggctcattgtatttttattgatatttttcatcgatcctacattaccgtaaaaagaagatcaacaggaagcaagccacgctttgaaaccgtggtaaaaatattagaagcctttaaccttaaattagtgccgacaataaaggcattgtaagttgataatgattaatttgcaaaaaaccttgcaaaagacgccgtaaaagtgtagtatttcagctatggtgcggttaagtacacttatagcataaataaacattttttacagccctgagcagacatgctcggggcttttttatgggatttttttggtgatttattatgaaagatatggggacgcaaagttatttgtggtcgggtctcagtgggtttatcgcttggctgggcgaccagcaaaatttgatgatgataagcctttctatcgggattgttaccgcttgtgtaaatctatatcaacggtacaaggaaagtaaacttcgtaagcgtgaaaacgaacgtgcggaagaattacatcgacttaaaatggcaagattacaaaaaggattagatgatgagtaagttggttaaagttggtggcatttgttcggtgtctgccattattgccttgatgatgttgaattttgctgacaattttcgcacaagccaacaagggcttgagttaataggacaggtagaaggctgtcgccgtgacccttatcattgcccttctgatgtgcttaccgtaggaattgggagtactgtggcaagtagcggggcaattgaaccgcataagcgttattcagatgcagaaattgcaaagcgttgggtaaacgatattcaagtagcagaacgttgtgtaaatcagttcgctaacggtcggctaatgcctcaatctgtttttgattcagtggtttcaattacgtttaatgttgggtgcggtaagttatctcgctcgaccatgtttcgtcaagcaaatgaaaaagattggagaggtgtttgtaatgaatttccaaaatgggtttatgcaggcggtaagcgattacgaggacttgaaatacgtagagagaaagagaaagcgttatgtttgtctggggtaaagcaactttaattgcgttattgggtattttgggcttgggtgttgcaatgtgggttcaggtacagcggattgatagcttaaaagccgacaacgcttctcaagcccaacttattattcgactgactgaacagctgaagatagagcaacaggcagtgcaaatacagcaaaagatagctaatcaatttaaagtaaagatggagcaaagcaatgaacagcttaagaatatcttgcaacaagagacctgtgcaaaagtggcattgcctcgtgatgttatcaatattattaaccaattgcacaacaccaccgcaaattgaatatctttctccaccacaagcctacactattccttgtgaacgttctgcttttcaggggaaaacttatggtgatgcaattaagcatttaatcaaagtaatggctgaacgggatttatgtgcaagtcagattgataagattcgggaatggcagattgagaatgcacagcattgagattttaatgttaatggtttaattatggcgaaaaaaaactggaaagcgttgcaaattgaatatctaaaagcaaatgcaaaaacaggtattactgttaaagattggtgcgagaagaaaggattaaagtttgccagtgcgaaacgttatataaaaaagcctgaaaccatgtttaatcagtctgaaagccgccaaacagtacgtaaagaaaaacaagcagaagcaataattcatcaagaaaactgcgaattaaattgcgaaacggacgaaaaaactgcgaaacgaaaacaacgctcttatgtgaattcgcagaccgctcgaaagcatggtggttatgctcgctatttcaaagacaaatctgcctttgatgttgtagtggattttagccttaaagatgaaattgatttaatgcgacagcgtgcggtcagtgcggttgaaagtatagaaaaattcaccgcacttttagccaatgccaacaccgcagaggaaaaatcactttatgcgaagctgattgagtccactgacaaagcacttgaaagagcggtcggtcgcattgagaatttaaatcacacggacaataacattgcaaatctcttaagccaaattgaattacgtaaggttcagtctaagaaagtaatggcggaaacagaaaaacttaagcaagagatgaatgcgaaaacagcgggacatcataagctcgaataccttcaggagtttaactaatgcgtattgtttatcgtgcttcagaaacgtttaaaaaagtacatgcctcaactgcgttggttaaagccattcgtggacctatcggtagcggtaagtccgtggggtgtgtgttggaaatgtttcgtgttgcacaacagcaagagccgaatgcacaaggcgtgcgaaaaactcgctgggcttgtgtgcgaaacacctatcctgaattaaagggaacggtgattaaaacctttcaaacgtggatacccgagcaaatttgcccgattaaatacgacagtccgattacaggtaagatgaatattaatcatcctgatgggaaaacacgtattgaagcggagtttttgtttctttcgatggataagccaaaagatgtgaagaaactaatgtcattggaattaactggtatttggatcaatgaagcacaatttttacctgtttcactggtaacagaagcggttacacgtactggtcgttatcctgaaaagcgggttgaagaagggtttatgggggcgacgtggaacggtatgattatggatactaactcgcccgatgatgaccattggtggtatcagtttgaacaagggattgatgaggaaactgaacagcctttaaagcctaaaggttgggagttttttgttcaacccggtgcattaattgatattacaggcatgcctttagcgacattgtcagatgaaataaaacgcaatattgaacaaggacattatgatgattatttaggacgtcgttttgtggcaaatcctaccgcagaaaatgtcattaatcataaaaaaggctatggctattggtttgataatattcaggggcaaacattaaactggatcaaatctcgagtgtgtaatgaatttgcaaccgttcaacaaggcaaacctgtttttggcgatcacttcaataaagaattacacgtttcaacagaaaaactggtaccggtcaaagggtgggaaacctttatcgggttggattttggtttaacacctgcggcgattatcggacaaattgcacccatcggacagttgcggattgtagatgaaattgtagcgacaggtatggggattgagcgttttattacggagcaattgtcgccactgttaagaagccgatatgcagagtgtgctattcaaatcataggcgatccggcaggtgttcagcgagcacaaactgatgaacgcacgtgttttcagttgcttgaggaatatggttttaatgctcgtcctgcagaaagtaataatacgacagcaagacttgaagcagtgcgttggtggttatcccgtttagtaggtaaaggtcagccggcaatgttgattagtccgcactgtaaaacattgattaaaggatatgaaaccggctatgcctatcgtcaattgaatgtgagcggtgaggaaaaatatactgaaacaccggataaaaatcggtattcacatccgcatgatgccaatcaatatctttgtttaggtgcaatgcctagcctttttaaagagcaggttatcaatattaaaacacatcaaccactaagcaatattacaggatattaacatgtcagaacaacttgcaaacgccattgaaagctatggacgaacacttcaaggcattttacaggagcaaattaaacaacgtcagcccatcgtgcaacgttggacgaaagatatgtatcaataccgcaatcaatatgaaagtagtattgatacagggaaatctaaagtctttgtgggatatacgagagcaaaaaccgatgcgtggtcggctcagatgacagatatgttatttccaagtgatgacaaaaactatggtatttcgccaacgccagtaccgcaaattgctcatcttgctaaacagcccgacagccaagatccaatgcaaatgcaacaaatcaacatggcaaaagagctaatgcaacaagccaaagagcggtcggaagctatggaaaaattgattgatgatcagctggcagaatgtgactatgcctctgaggctcgccttgccttgcattatgccgctgtacttggaacgggtattttgcgaggtccggtagtagatacaattgatgagcgtatttggtctgatgatggaatgggtaattggtccgcacaaaccaagtctaaaatagtgcctaaagtgcggttagtgttaccttgggattttgtgccggatatgaccgcacctacattaaaagactgccaatttgtctttgaacgttcttacctcactaaaaaacaattgcaaaatctgctgaataacccttattacttagccgatacggtgcaagccttaatcgaaagcgaggcaagcgaaacgcatacctccagcagtgatatggacggttatttagacacccttcgaaccttatccggtttagaaaaagcaagtaatgataaacggtatgaggtatggacttatcatggtggcattcctgtttctgtcttagagcaagctaatcaatctttagaagaaggctatgcgttggaattaacggaagagcaaaaatccgaaaaagcggaaattgacggcgtgattgtaatgaccggtaatggcaagattttaagtgtgaaccttaatccgcttgataccgcagagtttccttattcggtgtatacatgtgaacctgatgtcgcttgtgtatttggttttggtattccttatttgtgccgtgatgcacaggaaattcttaatactgcttggcgaggaatgatagacaatggtgtgttaacgattggatcgcaaattgtcgtcaatagttccgtactttcacctgtcgacaaaagctgggaaattaaaccgaataaattatggcgaaccaatgatagagcttctgctaatgcaagttttgaagctcaacgagcttttggcgtgtttaattttgaaagcagacaacaagagcttgctaacattatccaactggcgaaatcctttatggacgaggaaagcggtttgccaatgattgcacaaggtgaacaaggtcaagttacgcctacattgggtggcatgtcaatgctaatgaatgctgctaatgcggtacgcagaagacaagtgaaagaatgggacgaccaagtgaccaaaccgcttatccgccgtttctatgaatataatatggcgatggatgacgacccgaacatcaaaggcgatatgcaagtagtggcaagagggacgtccgccttgttggtcaaagaaacacaaacggcacagattattgatattttccaaaaattcggcaatcaccctcaattgtcttatgcgttcgattggtatgacggggcaaagaccttaatgcaatccatgagtatgggggcgaaaacgatgctgttatcaagggaagactatgagcagaagctccagcagatagaacaagcgaatgcgacgcaaccgcaagatccggaaattctcaaatctcaaatgcaaatgcagttagcacaacaaaagcaacagcatgaaatgcagcttgaacagatgaaattgcaacatgccatgcaaattgagcaaatgaaagtagccatcaaagagaaagagcttgaagtaaaaatgatggaaattgaaatgcgacaacatcaagagcaagaaagaatatcacttgatgaacgtatcaacagtgtcaaagtctcttccgatatgcaacgagaaaccagcaagcaaatgttagatatgaagaaattccaagcggaaattgctttaaaacaacaacctctcgccaatccaacaggaaactatggtgtagagtaattattgacattgtagaagttcagtaattccaaaaaaaacaaaccccaagtaacggctaattacttggggtttttcattccaaataaccagaatataaggaacgaagatttatggaaagtttaaaacttatcctatcaataatcaaggagtttagaaaaatgacagcacaactatccaatttacgcttttgggggctttggcttattggtttcttgattgcattatctatttttatcaatgcagtgaagtggtggtaacgtaattcccaaaaacaaaccccaagagccgcaaactcttggggtttttatttcccttaaccttaagcacacaaggaaaataatcattatgaattttaatatagagattggaaaaatgctagaaattattgcgaaataccccatagcagaacgctttgcttatgtatttactattttgttttttatctctgcggtattgtggctttcccccgattttttaaaagccctagcagattttatcttgacgatgaaaaatagttagagtagtatttacccatagagcttcaaaactcttttgtaacaatctaaaaaattcaatctatggacagggtggtgcggaaatatccaatacccacgccgtcgttacagcggttttgaacaccctgtccgcccacattctattcaaaaggaaatgtaacaatgtcaaattttactcatgtggtaaagccttaaacgaatggaaaggcaaaaagccggtattagaaggtgtgatccgcattatggaagataaaatgcaaattgaattaccgcttacagaactaccaaaactcacacaaatctaaccgcacaaagtgcggttagattttactggcagtcagtttgaatgccatatttttcagcgtaaagcaaaatagcctcagtaatcattgcattttgagcaagaccccgttcaaggctaattttttcgacgagatcgaaaatgtcttttttaattttaaaggatttggtttttacgccacgcttatcatcagagcgtttttgaatttcagcggttgactttgccataaatattctccataattaattttgaagaacgagagaggtttccccctctcgttgaattatcatcaaattagtacgctggcaggctaatgactaataagatgataactaggataatgtatttaaacattgtgttatcctcttcaaagttgggtggattgaaggtcgcacccagctcgtttccgcagtattgcgaaaacaagaatattataggtcgttttatatttctgatcaaggaataaaacgacctattttttatttgacttttaaaaatttcagtagtaatattcttctcaaggcgtcgaaacctaaacaaacagcggcaatccgcacccgacagcatagcggtttttttatgcgtaaaatttgtgatctgtttctttctctcaagaattttgattacgcatacccaaaatttatctatgtcgagagggcggagaatacaatacccgaaaggggaataatcccgaccgtctgtttgcggttttcgaacctctcggcaccctattgaatagggaaaactaaacttcgaaaaaacaaacaggagcagacttatgtctaatcaaattactactcaaactctttctttccatggttcagatcttattactctcaaagttgaaaatgttatctacaccgctattcgtccgattgtagaggcaatcggtttggactgggcaagccaatccgtaaaactaaacaaaaataaagaaaaattcgggtgttgtgatatcgcaacacctacaaatggcggattacaaaagatgatttgtatgccaatcaaaaaactcaacggctggctatttagcattaaccccgaaaaagtgcggtcagatttaaaagaaaaagtgatctgctaccaagaagaatgttttgaagcactctacaactactggcactttggcaaagccgaacgcaaaacgactgttaatgaacgcaccggcttacgcaatgctgtaaatatgctcgttagcaaaaaaggcttactctacagcgaagcctataacctcgttcatcactatatgaatgtggaaagtattgaagatatcccagcagataaattacaaagtgcggtggagtatgttcataaaatctgcttggagggggaactgattattgactcaccgaaacaagatgatgaccttgcagataatctaacgttaacctcaatgtggttcgcactttacaattgtttagatttgttagggcaaattgaacaacctttgcgagcaattggctcgcacttcggttcaacggcatacactcacgctacggaatatcgccatacattacaatttgcgagagatgtgctaatgcaaaaattagagggcgtagagattagctcttgggaagagccacactaccatttagcattgaaaacaatgcgagcaagagaatacccactgagaagaggtattaatagacgataatttagcaaaaattcacaaaccagaccgccaaaagtgcggtctttttttatttatttttaaggaaataccatgtcagactttagcctttccaatgaagaatttcagtatttgcaaaaaaacatattaggtatcgcaccaaatgcaacaggttcaagaggacgaggacaatcggatgttgcagatgagggttcttcgtccattgatgtcatagctaaccaatacaaattgccggaagagcaaggtttttttgccgatgtggttgatagcgttcaaatgggggcatggcgtggagcaggtgatttagcccgaggtataggagctttatttaacagtgaatggttaaacaaagcggctgattatgcctattacaacgcagaagaaaacaaagcgaccatgtcaagcaaaatgcaagaagccttggggcagagtgcatttgacggctggaatgaagaaactggagaaggcaaaggtttactcaatatgtattggtgggcgggcaatttgggagcattgctcggtgaaaacattgatacggttctcaccatgggagcgggtaaacttgcgacaacaggaataaaagcaggcggtaaacttgccggaaaatatttcagcaaagaagtcgcagaccaagtagggaaagcagcggtaaaacaagcaagccgtttcggtattcccgctcaataccacaaaaccattgcctacacggcgatcgcctctgctatgtcggcgggtaatcgtgcaaatcaagtccgagaggaattatcgcaaattagcgataatgacctagctcaacataatgactttcgtattgcgtattgggatttaaaagagagtgatgaagggcaaacactttccgaccatgaaatttttgaacaagcaagacagcagtattacaacaaggtcggacgagatgcgatactcaatcctcttgcgattgccgcagatattactgctaatgctgttggtggtttagggggtggtctttggggtctaccaaaggtaaataaatggctgggcaaaccgacacaaaatatcaaagagggtgtattaaaaggagcgttcattgaatctgcaacggaaggcttacaaggtgcggctgaacaatatgccatcaatgacacagcaagagattattacgatagtgaccgcagtttaactgagggcatgagtgaaaatattgctgatggcatggtattaggtgcagggttcgggggtatgacaggtggctatgaagctatgtctcatcgcagaaccatgaaccgtgagaaaaaacgccttttagaagcggtgaatacgggtgatgaacgagtggatgcacaaattcgttatcaagtagaagcctataacaaaattgccaatgatttagatgaactgatttcgccacaaagaatacaaacattaaatcaatttggcttacaagcggttgaaaaagcaagacgtagagaacaaattgaagcggaattaagaggggaaacacaagctcaagcagaaaaacaacaagcagagcaagttcaaacagtaaccgatacaccttaccatcaacgcaatttagccgatattcaggcggaatttatccagcatggtttagatgaaaatgattttaatgattttctagaagccaacttgcaacaagcgacagcagatttacaaaaacttcaagcaaacccatttaaaatggggacagatttgcaaaaaagtttagcggaaaagcaagcctataatgcaaaactggcggacacacaagcaagagtagactactggacacaggcaaaaaccgccccaaagtttggtactgaggctactcaagcagaaagtgcggttcaagcagagagtaaagttcaaacgcaagaacaagttacccctgatgaattgaaattaagccgttcagccccacaagaaacgcaatcattctacgaaaccgaacaaggattaagtgggaaagagggtgaatttagtgtaaacaatgatgatattcggtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaatcaacgatcctgttgcagtaatgaagtctgaaacacagcctaacggctatgtggtactgaccgaattgatagagcaaatgaacgataaaaataaacctgtgattgcggcgttgcatttaaaacatagcaatcaaggcttagaattgattaacattgcgagcgtgtatggacgttctaattcacaaattcaacgtggattggaaaaagatttactgtattggaataaagaaaaaggnnnnnnnnnnnnnnnnnnnnnnnnnnnnnnnnnnnnnnnnnnnnnnnnnnnnnnnnnnnnnnnnnnnnnnnnnaatattaaaaccgaaactgacttaagtcaataccaannnnnnnnnnnnnnnnnnnnnnnnnnnnnnnnnnnnnnnnnnnnnnnnnnnnnnnnnnnnnnnnnnnnnnnnnnnnnnnnnnnnagctcatcgcctttatctagtatcaatgataaacgccttttgcagattttgcaacaacagactaaatctttcgactttagccaagaaaaatcccaaattgcagaagctgtaggaaaaggactatcaaccgcattttgaggtggtacattcttctgaattaggtattaacgacccgacaattgaagcggcttacaataccaaaacaggtaagattgttattattgccgacaatattcgagccaatgacattttaacacgtgaagagcgtttaaaatgggtagcgtggcatgaactggcacaccgaggactacaagtgcggttcggcaaagagttcaaagccttgatggaacaagcagaccgaaatacgacagttcgagatttagcaaccgcacttcaaaaagaccgagcggaacttcgagacaatcgcacgttggcggtagaagaagcgatagcagaactgcacgctgcttataccacaggcaaaatggaagagttaaaaagccgttatggtctagttgttcctcgtggtagagaaataagcctaaaatcttggtttagaattaccgctgaacgcattcgagagtttatggtaaaacttttcggacgtgaaaaagcaaatcgttttagtcatgatgacttgcttaatttgttgaaagacattcagcaaagtgcgggcggtgatatacacgaatcggataataatacacgttattccttaaatgaagatccaaattcaagttttgctaaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgcttttcacgttcaagcacttatcaatcaggcgataatatttccgtattagaactttctcgtggtggaaatattcaagcaccgaaatggacggataagttcagcacgcttcaagccttgaaagaaacttttcatcaaggaacggcaaaattggacgaatggtttgctgatagcttaagaccggtaaatgattggatagacaacatgcagtttagcgatcataccagcaataaaagtggtcgagaccatgaaaaacgccgtttaaaagacgcaatgtatacagcaaaaggaagacgtgatgccttaaattccgagtttgaggttcattatttgaatccgattttgtcgaaaattgcagaaattgctaaacggtcgcagggtaaaatcaacgaagaaacggcaaaaagaaaagccggtttttgggtttcagcacgttattccattgaaaagaatatggagctattgagcattgatgaaaaagctatgcaagaggctcaaaaagccttagatgacgcaaaaatcaatgggacagtagaagatattcgcaaggcaaaaaatgcctttaattcagcacaaaaacactatcttgaccgtaaagcggcagtatggaataaagactttaacaacaagcactttaaagcaggagttgccggcggttggtctattcctgaagcccaagaaattatgcgtaatattgagcgtgatatttcgattagagatttaacgaccatcggtgatttaattgcggagttaaaccaagcacggttagaaattgattataagagcggtcgcttaacagacactgaatatcagcaatttaaagcgaaccgtcattatgtgccgttgacaggcgatccgaatgcacaattagacgacatggattttatcgcaggtgctggggcaaattcgttgaatattgccaaggataaagccttaaaagggcggacaaattctgaggcggaagatgctattgacgcaatttggaaagcggttggaaaatcgacaacctatgccggttggtctgaatttaaagggaaacttgatgcgttgcttgaaacggaagtgagtttgcttgaacagcaaggctatagcaatgtggaagcacaacgcctagccggtcaaaatttagggattggcaaacaaaaaatgcaaggactgacacgcagtagcgataatgtgttaattgctagacgtggaggtgtgtattatgaatatagtttgcctgacagggttatttctgccctgaaaaatgataatgtggagcaggcaaatgatttcctgaaagtgttatctaagcctacccgttggtatgcaagaggagtaacgcagtggtcattggcatttgctccgattaatatgctgagggatacatgggaaaaatccgaatttattcgtgtgcaaaaagtatatgacagacaaggtaaattgctcagtagcgataaaatggatcaaatcggaagagcgactgcactttcacccctaacaaatcctgctatttgggcagcaacgaaacgctttgcttttgggcaagaattgcgtgatagtgtgttagaagaaaagctattgaaacagctactcaaagagggggcgatttcaacatatggtacttatctcgaacgcacagaagcggatttactcaaacgcattaagcgagaaaatagcgtgctggggagtaaaatagacaaggcaatgggcgtgattgaaagttataatcaaactttcgatatggtttccgcactttctgcttacaaggcgttagtggataatggcgttgatagtaaacaagcagccgcaacaacattagaactgactaactttcgtaagacaggttcgaaaatgcgaggtattaaagccttgtatatgttctctcaacctacagtcatgggagcggcgaacttaattcgttatctttcaacgaagaaagggcaaatacgttttctgacgtataccgcaggaatgatggcactttatagcctcttgcgttctatggatgatgaggacgaggcggggaataaaatggatcagctgggtgatattacacgttttatccctattccaataggcaatggaaattatattaaacttcctgtggggtttggtatgcctcaaatggcgtggaattttgccacaaatattgtgaaaggtgcggtgtctgatatttcctttatggaggcaggcgtgaatatggttacccatgccacaaaaacctttgcaccagtttcgccatcggaaatttccgcattgaaatacccgttggaaaaattagccttaacctttacgccaagtattttacaaccgcttatgcaaaatgcgttaaatcgttctgcttttggtagtcaaatcacgacaaattttgttcgccaagacaaactcaaagctgaacaatccaagtcgacgaccgcacaattttggaaggatttagcgattgatattcaacaaaccttaggtcttgatatgcaccctgaacaaattaaaaatttgtttgatggatatagtggtatgttaggttcattgaaggagttgaatacgtggcttgtggaaaatccgaaccgtgagcaattggggcgtaacacgagaacattgttcattaatcagttgtatggtgcaggtaatgaatttgcggtgcaatctcgttattatgaagcgagcgaagaagcacaacaagttgctaaggagtatgcttatcgaaaactcaataaacaattggatagggaatggctaacgcctgaacgccaagagttaatcaaatggcatgagtataacttgcgaaccatgggcaaattacgcagtgaaaaggcacaactcaccaaacagttaagagcgggaaaaattagtgcacatgcttatgagcaacgcctcaaacgctacaatgaagcggtaaactcggtacagaaaaaactgctgtcaggttatcgccaaatggtagggttaagcagttattgacctgtaaaaaaagcaaataaagcctgtgttaaacaggctttttcggcgtgtaataatgacttgctcatttctttttaatagattaaaatctataaaaaagataaataggcaatgtaatgcaacaagagtggaatgtgattttgcaagatcctgttttggagtggtttaaaacgctaaaacaagaggatttataaaacgatgatagcccttgctgaacaaacttatgaacactacctttcacaattagagcaggagtagcaaaatgagcaaaaactttaaagcattgatggcagaattaccgccggaacaacagaacaaggtgaaagaaatggctcaagaaatgagaatggagctacaactttatcgtattcgtgaagtgctggaaatctcacaacaacaaatcgcacaagcaatgaatatcaaacaaccctcagttgttgctttggagaaacgaggaaatgatgtgcggctttcatcggtgaaacgttatgtggaagccatgggtggagtgttgaatttatctgttcaacttccaacaggaaagacaatctcttttaacttgtagcattcataaagcgacataagatatagttgcctgatattttgcagaaattgccgagttatattttcaatgtaactcggttttttattggggaaaaacatgattaatttgtccagtgagcttgaaaaagagcaattaaacactttttttactcggcgagtaaaagaatatcaacaagatttaagtaacgagggattaaatgcccagcaatataatattttgcgagggcaaattaaagaattgcaggaattaatcgctttactaaatattcattcaaactgaacctacccaccaagtgcggtaggttttttatttttaaccattcaataagccgctttatgccgctttaggagaaaacaatggaaaatcaagaacaccatgagttcaacgaagatgccgcttttgatgaagccgcgaaatcgctcgaaacaggtgaactgactgctgacagtttgccatctgatgccgagaaaaccgaaaaggacaagcctgatcagcttgaatccgaacctgaacaacaagaaaaggttgaacaggacgatttgcccgattggttgcaatctgccacagatgaagtgaaagagaatttccgcaaattgcaagcagataaccaacgttaccaacatcaagcccgttcacaaaatgggcgtgttggggcgttgacaaagaaatatcagcaagcacaagctgaaatcgaacgcttaaaacaagagcattcatatgcaaaaccgcagttaaatgatgagttaaaggcgttagaagatgactatcctgaatttgctaaaatgttccgcaaatttgccgaacatcaagatagacagcttgctgaatatactcgaccgcttgaacagctagcacaagccgaaatgcaagatcttgctcaacaacaactggagaacagtatcaactatgttagccaaattgtgcctgatgcggagcaaattttaaacaatccgcattttgctacatggttacaacgccagccagtaggtattcaagccttgttcaattctgatgaagtggatgacgctatttatctgttgagtgaatacaaaaaaaacatttccgcaaatgaagttcgtaaagcaaaacaaaatcagcaactctccgccctttctttaccaagtgggcgaaccgttcctaaaggtggggaagaggtggacgaggatgtttatttcaatcagatcgccgcacaacttgacaagcagcggtctcgttattagttcatcttaaaagaggaaaaattttatgactacaatgacaaaatattctgacattagcccacgtactacagtgtatgcggcagctcaaatgcttaatcatgcagagccgattttggtgttaaacaaattggggcaaactaagcctattccaaaaaacaaaagtcaaaccatcaaattccgtcgtcctaagccatttgctaccgcacttgctgcattaacggaaggtgtacgccctactcagcaaaaaatggcgtatgaagatgtcgaggtgtccttgaaacaatatggtgcatggacggaaattaccgatgtgattgaagatacacacgaagatccggtgttaaaagacattactatgctttccggtgaacaagcggcggaaactgccgaaatgttgacatggggtatcttgaaagcaggaacaaatgtgatttattcaactggtacagaaacaagtacggtaaaagatgtattaagcattaatcacattcgtgctgcggtgcgtaaattacagaaaaaccgtgcgaagaaaaaaacctccattttagatgcgtctattaaatatggtacgaaaccgattgaggcatcttatattgcggtttgtcatactgacttggaggcggatattcgtgcacttgccggttttacaccggtggctgaatatggttctcgttcaccgattgttccgcaagagtttggtacggtagaaaatattcgtttcattacctcgccattgtttaccccacaagaagatgcgggagcacagtcaagcgatgtagtatcgaaaagcggttcaaaagctgacgtgtataacattgttatctttggtcaagacgcctttgctacctgtccgttaaaaggcaaggaatcggcagatatgctgattcgcaatccgggtaaacctgaaaaaggcgatgagttgggacaaaccggctcggtgggttggaaaatgtggtgggcaggaaaagtcctcaatgaggcttggctcgtccgtattgaatgtgccgctaaaaaactttaacccaattatcacaagtagccccatgtaaaagtggggctttattcttcatgaggaaattattatgtcttatccatttatttcatttaattcgacagtagaacaattaaaaacacatttacgtgaacactgcggtatcgaaaaaagcggtagcaaaaaagaactaattgaagcaattttagcgtttgaagaggaaaacggattcgtgcgtccaaataaagacgtggcagagcataccgctcctgtgaataaccttgaattacctttagaaaagcaacgaaaagtgcggattaaaattgcagaaactgagcaagatcgcagtgatgtttatgtgtctattaatgattgggacgcattgattaaacgaggtgtagaagttgttgtgcctgaggcggtgtatgttttattatcaaaagcaggcgatcaaacctttacgcaagaaaaagacggctcactaacagaaggtttcagtcctcgctatcatgtgactttattaggttatgaatcatgaattttttagcgttggctcaacgtttacgccaagaaatgaatgattccggtgaaggacctgcacaagtaacgggacaacgagggcgaaatttagagtatgttaacgccataagagaagcatggcttgatatacaacaatgtcgctcttgggcggttcagttttggcaacaaggctttagccctgataaattacagatacttgaaaacactgttgatacgccgttcattcctgcacaatatcatcttgcaatcgtattttatgcgatgcaatccaaagccatttcacaaaatgcacaagaattgatattgcgaggacagcaagaatgggacaaatatctccatttactttgtcgggactttttgccgacgttgaaagtaggtaggtagacaagctatgttgattattttagaatagccatattattccattttatttgaggtctttatgtcaaatcctaatgctccctacattcgggaaattgttgatcgctcacgcctaattggtggaacagcgatccaatctcaacggaaagatgacgtaaaaaaagccgttttacaggtattttctcaacaggcttaacgcttaaactaatttgtcaaaaaaacccgacttgttcggggttttttcttgcctattttcaggagttccaatgaaactaccgcaaattcaatcactgtttgttgcgataagtgggggtatggatttaaccacaccgcccattgttaaagcaaatagtgaagctattattgcgttaaatgtacaacctaattacggtggcggattttctcgtattgagggatatgaatgtttagacggtatgactaccccctctttaatgaaccattttcatgtgaacgttaatcacgatgttccacaaagtgcggtcggaaaacagtttttgttaaatgaccgcacttgttatgtgttagcagtgaatgaacgttgtttaacctttgccgtttcgggacagtttgaggttgatgtcggtacaacctttgaccttgataggcaaacctatcaaaccatctcaaagacttttttgaatacaggagaggtcaaacaatggcaacattaccaagcactggcgtttcaagcgggagtggacaatgtgcaagcggtaccgggtgaaaatgccttgcgtggtgttgttgaacttaacgagcaaattatcgcatttcgagatggggaaaatgcttgtgaggtttttttagcgaccaaaacaggttggcaatctgcacctgccacttattttgttgagcttaaagacatcagcaagccaaaagaatttattgacggtgtgaagtttacttccggggaaaaacaaggaaacgtattttctgccgtgttgtcggctgatgatagtagcggtcatcttgtggtcaatactgctcttttacccgaggcggaaattcatattaacggtagtgttgcggctaaggtgaaaagctgtgaagcggtcagattgacaaaggaaaaggcgtggacatttatttatcataatttttatggtgggacagaaacggcttatgcttacggttgtaacggtgagcaggtaattgaagttcgtcctgatggtattatcgtaccgattataacccaagcggaaaatcctcaatatattgttgcacatcgtaaccatttatttatcgccttttcagggggacaattcgggcattctttagtgggcaaacctacgcattgggcagtattgctcgggtcggaacattttggtgtaggcgatgaaatcacagcactgtcttctaccacagggggcgtactgttaatcggttgtcgccataaaaccaccgcactttatggctcaacacgtgatgactgggtattaaaagatattgccaaggtggggattaaatcaggtacgctacaagcaacctttattccgattgccattagtcgacatggtattattcgtgtcgatgcaacggagcaatttggtgattttaaattaagcgaaacagactccggtcgcaaattgggtttcaaacccattgaaaataatattgtcttttcttccacaaaagccaaatcaaaccaagtgcggttttattcggagaatgcgtttcatatttgcatgatgttacaaccggacggcagtacaaaaagcacctatttcacttatcccgaaaaactaaaaggcgtatggcaatctcatcataatacgtttttagcttttgatgacggcaaagtctatcgtcaatcggatgactgtttttcttttgcaggcaagccgattgaatggacagtgaaaatggcatttaatcactgcggttcgcctgtgcatattaagagctggaaaagtgcggagttacaagctaccgcacagggtgttttgtctgtgcaatatcgtttcgatttggattataacgctgattttcatgcagtaaatcttgcacgggagttatctgttatcggtcatggtggacgttggaacgaaagttattggaacgactttttatggtctactcaggaatattctacccccgtactttatttatcgggttacagtcgaaacctatctttatcttttgccggttcggatttatacgcccctcaatttgaactgagcggcttagtgttaaactatattttaaggagatttcatcgtgtctaaaaaattaagaaattggtacaaaagaactcatgattttgcaccctatactcgtgctgacggaaaagcggtatcagatgaatttgatgcaatccaagcgagttttgaaaaaatgcccgctatgcgagatgacggactgggctttgaagaaagtccggttattcccgacccgacacaggataaccaccctgtacccttacatttgttaaaaacggcggaacaatcggtttatgcggcgagggataaagtcacggagcttgctcaacaagttgcagacaataacgcaacaacggagcaaaatacccgcttagctatccaatccaatgaacaagcccaacaagccaaaacagaggcgagccaatccgccacacaagcgattgacgccaacaaccaagctcaacaagttaaaacggcagtacaaaaagcgaaagagaccgcagtttcttcaatgcaatctgcggaacaatcaaaaaatcaagcaatacaagcggaaaatttagcgaaaaaatgggcgtccaatcctcaaaaccaaatagtacaagaggggaaatactctgcttaccattatgctctagaagcagaaaaatacgccgaaaaagtcaaagcgaccgcagaaggacgtaaagattggcaatttattgataacgtccctatcagcaaagatattaacgacagctcagagacaaatttagccagtgctttttcggttaaaaccgcctatgacaaagcggttgaagcggaaaaaatagcgaatggcaaaagcaattttaaaatagaacaaggcaaagacaacgcagacgactacaaaaccgacgggcactattattttgcgagcggtcagaatttgcccgataacggtgcatggcatgttgaagtggtgagcggtgggcaagctaccgccgtgcgacaaattgcacgcaaagcgaacgataccggcgtcaaaactcgcttttttaatggttcaaattggacagcgtgggaagatttgaatgtttcgggtttatttacctatgaaaaaacaggtaattatgagaattatatagaagtccgccaatacccagatggaactatgatacaaacaggtagagcttcgttgatatatacgcataaaacatattttttatacaaaaaagtcttttttcatgttgcgtttagtgagccaccgttaatcttcaccagcctagtcaagccgaattctgaaaaatatcaaatctaccgtaaagatgaattaaatgtaaatgttatctcaacgaagattaatgaaacaggatttggaatcaatttagttgatgatgacgttcatgattcagaccccgaaataaaagttgactttatggcgattggacgttggaaaccgagccaatttagtttctaaaaatccaattgcgtcgcatgaattcctaaagcaagggcgattttttcccttgtggctttacgcaagtgagatgatttttcatattgactatatgcagattgagtaatatttaaacggcttgccatgtctttttgcgttaatcctaaatgctcacgccatgcaacaagtgcggagcaattattttctaaggcaaaagtcgccacagcaaaaggcacgccactatctaaaggagaggaaagttttgcttgttgttttaaccattcaagggtagcgatgggcatgacggcaaaagcagggtgtccgctttcatcatgtaaatattgaatgttagtaagtgcgttcatctcgttttttcacctcttcaatggaaataatattcatcatatcgccggcaatttcaaagaaaactcggtaatcgccgaccctaaaacgataggggtaacgatgattaacaagggcttttacattagaacaaaaaggaaaatgcgttaattcttggcattttcgtgcaattttcgcccctgttggaatttttcttaattgctttaacgctttgggttggaaaataaccgacttcatgaataaagaatataagttaaatataagtttattttagcaaaaacaacaaccaaggacaacacatgaaaatctactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccgcacatttaacccaagtgcgggcggaaatgcgagagaaaatcaatgccttgcgagatgaaaaaatcaatggcggggtatttgtggaagcggtgggcaagtggattgatacggacgccacggcggagcggaatatcttatccgtcaaagccagttatgatttattcggtgatatggaaattgcgtggacttgtgcggataactctgtattgatgataaataaggaaaaattaatgctgatttggcaggcgttaatgaatgctaaaacaggtaatcatgctaatgccttgaagcataaaaccgctatggagcaatcggacaatccggcggaatatgattattccagcgggtggacaaccagttatggggagtatttgaaggagttgagcaatgagtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtgagagtttgcaagaccccaagcaaaaaccgcttacacaaggcactacgaccgcacaacctcaaaacactagccaatcaatgccatcaatggcacagaatgtaacgaacaaccttaacagtaactcgttattaatgaaaagtgcggcacaaaaaggcaatcgaatggcggcacaaagaggattgcaaaattcaaccatagggattgagtctgctcaacgtgctatgcttgatgcggcaatgccgatagctcaacaagatacgcaaaatcagcaacaaataaccgtagcaaacttgaacgctaaactttcacatgataacgcaatgaaagagttgggtgctcaagtgtcggcgaatacaatcggcaaatctattgattatgcaatgcaaattacaaataactttgacgctcaaattgccggtgtgctgaataatacacagatgaaagaggaggataagaaaaaagccattgaacaattgaaagcaagtcgtgatacggaattgagttttatgagtaaattcatgcaaaaaattccgaccacacaaaaagattgggcggcattcccgtcattgggcgtaccgacaatcacaatgaaaccaacagaaacagggggtaaagtatgagtttttgggattcagcttggagcgtaattacagagtctgccaaatggatggaaaaaaaccaagcggcaacaaatttaatgggaagtgtactacaaggaactgcgggctattttcttcaaaaagagcaaaataaaaatttaatgcgacaacaacgtgaattgcttaatttgaaagatgaaatgcaatcaaaatattctgcggtaccggaagtagactcaggttatggtgggcttgtggttgatgagacacctaatttggcgaatggcggtattttaactgaaatgaaaaaaaaggtagatagaaaaggagtgtagccatgggatttataaatgatgccggcggtggtacagctagaaatattcgcgatatagatagagacagagatagaggtcgcaataatagctatgatacgaaaagtttggacaatttagctaaagctattcatgacggatcttacaaaggtaaaaatgatagcagatggtctcgtcgaggaaaggacggttatagttcattcggtagccatagggataatgataagtatagcaactatgccggcagttattctaaaggaaaaagtgcgattggaagtgcggtacaaaaccatcgaaatttagtagctaattctccgtccgatctcaaatcaaaaacgctaacgggtgaaaatgttgatgatggtttgttgtcctcaaaccaaaataagcaatatagtccaattgactatgctgaaatgtataaaaacggacctcgtcatccgatagaaaaagcaacgttgggtaagcgagaaatgggaccgatgagccgaattgcacctgaagatccacatgctaacagctatcaaaactacagatatgtacaatccttagcgaataaggattggatagaagatacgcaacgaagcatagccggaaatgcggttggcggaatatcttcctccggagtggctaatgcggttgccggtgctgtagggggcggcttaggcagggctgtagccggagcagtagcgggaatagcagcatctaatgccggagatttggctaatatggcagtaggtaaagccaacaaagaaggattaacagatgaacaaaaagcaatgtacgatcaagttttctcacagagaaaggattatttcgacaagagaagacgttcatttgatagtttcggtaatggtatagcgactgttcttggcaccggtgtcgatattgcttcaaaagggctaaccatgggggcaggctctaccatcgctgatgcctacaaaaataattcggcattggagaaaaccttggaaaattttgatagccctgaaaataggcaatttttaaaagaaagacaggaggcgtacaagcgtgcaagggaagaagatgcgaaaagacgcaaagcagatgggtcaaataaaggcattctctacaatatgactaaacgtctacagcctcaagaagagccacaagagccaactttaccttactatgctattccggcattaactaatctttggaataacgtcattgtgaaataaacaacaggagaaaactcaatgggtattttagataatatggcacaacaagccaatgcacaaccgcaaatgcaacaaacggcgacactaccacaaactgaacaaacgggaaatatgatgcaaatgtatcaattcttaatgcaaaactcaatgcaagccatcgcagaaacggcagagcaacgcattcacgaaaaaggaccggtagacggaacggcagatttaattgcaaccgcaatggtttcaaatcttcaagcggcacaacaaaatggtaaaaccatccccccacaagtcatgttacaggtcgccaaagatattgccatgcagttattacaacaaatgggcgtaccggaagagcaacttgatgatgtattgattgacgttttatttaaagcgttggatcaatttggtgaaatgagccatggcatgttatcagcggaagaagagcaacaatatgttgatatgatcaacaaaatatctgctgcggaacaacaacgtcaagcacaaaaaggcgaaaatccgaccgcacttgaacaggcacaaacgggaggtatgtaatgggatttggcggtattttagcctcaattgctcatggattgggcggaggtatgattaaagtcgcggatgagggctggaaaaaagaggcagacgagcgtaaaaatcaattctatgcagatcaaaaagcattagatcgagaggctgaactaattctattagacagaaaacatcaaaatgacattaattttttgcataagaaaaatgcgatttctcaagcggttaacaatagccctaatatgaaagcgatgaatgaaatcaaagacgcttttgatgcaatggacgcaggaaacaaagaaattgcacgacttgatgaactattagcggacaaatcactttccaaagagcaacgagaaaaacttacatcgcagagacaatcaatttacgatcatatttcttcggtagccaacaacaaagaaatttggaaaggaattgatagtggcagatatggtcaagcaatactcagcaaacatattcaaatgactgcaccatacaaaaagacaccatctccagtggctgtttcgcaaaagcaagctaaccagcctataattgtaccaaaacctgacaaagctcagttatacggagaagatattatgaggagataccacaatggagaattactagactagcaaaaactctaaaaacaaaccgctctttggattgaattgaagagcggttagaatttattttgtaagctgtatctttgcaagatgtaatggtagttaatgagatgtgaaaatgtgacataaatgtgtcataaaaggtgaaaaaagatagtaaaaggcgtgttttttataggagggtgttctttgattagctttgtaagtctttgttttaaatgttgtttttgttttatttggtttttattaattgctcttctaagccgtaggtcattggttcgaatccaaatagggcgtgccatttcttaaattcctctaacaaccaaccaactacagctccaatgatctaaactaacgacagcttaaaaaacaagtattttttgctatctcaaaacaaagtattgtatttatatacagtataaattatgatctaaaaaaaccgattacagaatttaactgttaccaaaaactgatccaaaaacaaaaaaagtgtaccaaacagcagaattaaaacccaagccatgtttaaaaaaatcacccaagcaaggcacatgaagttacgccgccaaaaagacggtatagaactagggtttagcggaaataccgcctacatcgccactattcatcaatatggattaagagcaagagtagaacgacacaaagaacacaaagtacaatacgccaagcgtgaattactaggccttacagagcaggataaagaaatgattgaagcgtttgtgatcaacgcattgagtgaaaatattgattagatgtcatcatctaaattcttatttttgcagtggcaacaatttttatcacgattggacgtatcataaaacaacacaaagataaaaaataaagcaacactgccaaaaataaacgtcagcccaacgcttaaatcaaaataaaaataacaaataaggtaaggacatgcgacaattaacacaaaaataaggtcaataaaattattaacagtcaatttacttttcatagaaccaccgtagtttttgtcgttattgtctttttatattaaaaaatagcaaataaccgcaataagaatgatggcacttatgccccattcaaggctaaattgataatcgacctgttctttagcatgataacgtccggatttcttttgaattgccattagcactgtatccaaaagtaacatcaaaggcgttaatgcaaacgtgaataacacgcaacctataccgacagggatagaaagcaaaaaaacggaagtaagcaaggaactgaaaaaatgaatgacagataaggtttcccaactcatccttagcgaaataccaaacaacacaataacggtaaacatagcactgatgtagtacaaatgagtaacccaaaaaaaagtaaaattttcatactttaattcatcgtgtcgcataaaaacccctgtgttttttgtgtatctttgtttattttttctacgttgtcaatcttatttaaacacattaataaattgttctcgagatcggacccactcataaatcactgacaaaaatagttttggtcagcattgccggttgattatcatccatatcagcaaataatgtggcaagtttttgctgtgctgtgtcataatcaccttggcttaatgcgttggtcaccggattcaatattgggttcattaattgttgatatttctccggtgtcggttctaatccgtctcacacttcatcaggatcattttgtaccgataataacgctattttccctttgcctatcttttgaaccgacaaaagtgcggtcatatttggcggtgttttacgctctaatacagcttcgttttctgttacggtacttgcagtttattcgtataaactttgttgatgttcatcaggtctggttttaaatcggcgatgtaaccacatatattgtgttacatcttgcaatatttccttttctacaatcttattcattcgtgtcgctattgccgtttcatcatggagaatatccgaaaaatcaacaggtgctgaaatgttcaacgtatatccagagttatctttgttacgaagcggtgtaaaagggataactttgctcttaggtgatgattttattaagtagtaacttccggttgtcgttgccgcctccggtacagcaaaaaaaggtacgaaaacagcattttttcttccataatcatgatccggagcgtaccaaatcatttcaccatgacgaatagctttaatcattgcacgtaaatctttgcgatccaataaacctttatttgatcttgcacgtccacggcattgtaaccaatccattaaaggattatcatgcggtcgataaatgccaatgcctggatgagatagaccaataatccttgcacctaattctaaagtgagaaaatgaatacctacaagaataataccgtcttgttgattttcttttaaatattcaagcccttcaattttgctccatttttttattcgtttatctgaccaaaaccaagccataccggtttcaataattgccatgcctgttgctttaagattggattgtaatatatcgttgatttcctgttcagaataatgaggaaaacagagctgtaaattttggcgagcgatttttgttctgcgttgaccgattttcaaacgagaaaataaagaacctaaaccgttgccgattttaagtaagattgggtaggggagcaataaaataagacgaaaaaataaaaaacctaaccagaaaagccagtatttaggcttaagaaattcaatattaaattgtggaattgatgtttttgccataatgttacttagtctaatacaactttgattttgcgttgtagtttaacggaaatttgacgaaatagcatttttactgtggtaaaattagcaaaattttagtgattttatgagagaaaagaaaaatgatgcaatattcagcacagtttaatcgagctaaagtactggtgctcggtgatgtcatgcttgatcgttattggtttggggcaaccaatcgaatttcacctgaagctccggttcctgtggttagagtacaagaaaatgaggaaagagcaggcggtgcggctaatgttgctatgaatattgcctcgttaaatgtacctgttcggttattgggtttaacaggaaaagatgaagcagctagggcattaatgcagctattggaaaaacaaagtattcattgcgactttactcaacttgactcgcacccaactattactaaattacgtatcctatcacgtcatcaacaattattacgccttgattttgaagaggatttcaacaatataacaagtgcggatttattgtgtaagcttgaaagtgcggtacgaaattatggtgcattaattttatctgattacggcaaagggacattaaatgatgtacaaaaaatgatccaaattgctcgtaaagtaaatattcctgtcctgattgatccgaaaggaacggattttgcacgttatcgcagtgcgacgttattgacgccaaatatgtctgaatttgaagcggtagtgggtaaatgtcatagtgaagaagaaattgcagagaagggcttgcagctaatcaaagagcttgatttatccgctttgctggttactcgttcagaaaaaggaatgacattattacgtccaaacaatgcaccatttcatttacctacggaagcaaaagaagtgtttgatgttaccggtgcgggcgataccgtaattagcgtattagcaaccgcacttgctgacgggcgtagttatgaggaggcttgttatttagcgaatgtggcggcagggattgttgttggcaaattgggtacatcaacagtttcaacagttgagttagaaaatgccattcatggcagaactacggcaggttttggcattatggaagaaagtcaattaaaagcggcggtggaattggcaaaagcacgaggagaaaaaatagtgatgacaaacggttgctttgatattttacatccggggcatgtgtcttatttagaaaatgcacgtaaattaggtgatcgtttaattgtcgctgttaatacggacaattctgtaaaacgtcttaaaggtgaaactcgtccgattaatgatttagcgactagaatggctgttttggcgggattatcttctgtggattggcttgttgcgtttgatgaagatacacctcaacgtttaattgcagaaatattacctgatttattagtcaaaggtggagattacaagcctgaggaaatcgttggcagcaaagaagtctggctaaatggtggcgaggtcaaggtgttaaattttgaaaatggctgttctacaacgaatgtgattaaaaaaattcaacagttaaaagagtaagggaacattatgattacggtatatggtattaaaaattgcgatactgttaaaaaagcattgaaatggttagcagataacaatattgaataccaacttcacgattttcgtgtagacggtttacaacaatattggctagaacaagcggaacagcaatttggctgggaaaatttagtcaacaaacgtagtacgacatggcgtaatttagatgaagaaatcaaacaaaatctgactaaacagaccgcacttaaaaccttacttgcacaacctactttagttaaacgtccgattattttacaagatggcaaagcgttgattgggtttagtgtagaagattatgaacgtgtattgaaataaaagatcaacaacgttctatttaacgtatgacatattgcaatagtgcaaaatgaaactatgaattgataaaaggacagatgctacgcaaacgttcgtaaaaaaataaaatcttatgaaaaataacataattactctcactcaaagtcttattcaacgtccttcaattagccctgatgatcaaggctgtcaacaacttattgccgaacgtttacaggcggttggttttaagttggagtggttaccttttggtgataccttaaatttatgggctactcatggtgaaggaaaatgtattgcttttgcggggcatacagacgttgttccgattggtaatgaaagtcaatggacttatccgccttttgaagcccgaattgttgaaaatatgctgtatgggcgtggtgctgcggatatgaaaggtgctttggcagcaatggttattgcggcggaaacttttgtgaaacacctgccaaatcatcagggaaaaatagccttgttgattacctctgatgaagaggcagcggctaccaatggaacggtaaaagtagtggaaacgctaataaaacgtaacgaaaagattgactattgtgtagtaggtgaaccttccagtgcaacgcaatttggcgacattattaaaaacggacgacgtggttctattacaggaaatttgtatattcaaggtgtacaaggtcatgtggcttatcctcatttagcggataatcctgttcataatgccttgaaattcttagatgaattaactcattatcaatgggataaaggtaatgaatttttcccgccgaccagtttacaaatcgccaatattcatgcagggacaggtagtaataatgtaatccccggtgaactttatgtgcaatttaacttgcgttattgtactgaggtgacagatgaaattattaaaactaaagtggctgagatgttggaaaagcataagttaacgtaccgtatagactggaatttatcgggcaaaccgtttttaacacctcaaggaaaattagtaaatgccacagtggaagcagtagaaaaatttactcaaatcagaccgcacttagatacaggaggaggtacttctgatgctcgttttattgccacaatgggagcggaagtcgtggagtttggacctcttaatcaaaccattcataaagtgaatgaatgcgtgaatattgatgatttagccaagtgcggtgagatttattattatattttggaaaaattgtttaatgaacaataagttatcaaaaatcctcacaggaaaaagtcgtgaacatttaatttcattaccgaatacgctttcggctaatcattttttgcagatggaagttgtcgctgcttttttgcagttacagcaagctgcaaagcaagctggctttaatttacagccagtaagtagttttcgtgattttgaacgtcagcgtttaatttggaatacaaaattttatggggaacgtaaagttcatgatgatcaaggaaagccgctagatttgaccgcacttgacgattggcaaaaggcacaagcgattttgcgttggtctgcgatgcctggagcaagtcgccatcattggggaacggaaatcgatatttttgatcctgatttattgccaaaaggacaatctttacaacttgagccttgggaatatcaaactggtggttattttcaacgcttaactaattggttattagttaatgcacaacaatttggtttttattttccattttttgagttaaaagataaaaaagtgggcaatgaactttggcatttaagctattttcccattgcagatatatatcaacaacaattttgccctgagtttttatcacaagcgtggtacgaggaaaacgttgcgggtagcgagatattattgaagcatcttgatgaaatatttagggattttttgatttaatgatttaagctatttttagccaatccaatttttcataattttagaggtatatatggaagttcagcaatttactcagcaagatattgaaattcttcatgaagaaacattgtacaaaggtttttttcaattaaaacgcattcaatttaagcataaactgtttgctggtggtgtgagtgaagttgtaactcgtgaattactttataagggagcagcatcagcagttattgcgtatgatccatatttagataaggtgattttagtcgaacaagttcgcattggtgcttacgatcccaaattaaccacatcaccttggttatttgaattaattgcaggtatggtggaagagggagaaaaacctgaagaggttgcactaagagaaagtcaagaagaagcaggcgttcaagtagataatttgcaacatgttttaagtgtgtgggatagtccgggcggagtgattgagcgtatccatttgtttgccggaaaagttgatagtacaaaagcgaaaggtattcatggcttggcggaagaaaatgaagatattcaggtgcatgttattagcagagaaattgcctatcaatgggtctgcgagggaaaaattgataatggtatagcggtcatgggattgcaatggttacaactcaattataaaactttgcaacaacaatggttataaaatgtgatacagattatattttttataaaaaattagataaaaatatgatcctgttaacattttcattatttttttaatgcaattttttattaaaacagtaagttataacccgtttgttgtatataaagggtgaatattttgatcagtacatatcaataccctacttcagagaaagtagttcgtttaattcagattaccgatccccatttatttaaagaaaaaaatggagaattacttggtattaatacgtatgatagttttaatcaagtattaagcgaggttttacaaagtaaatttgattatgagcttgttttagcaacgggagatttagtacaagatagcagtgaagaaggttatcaatattttgctgaatcggttaagttgttgaataaaaaagttttttggattccgggaaatcatgattttcaacctaaaatgtttgatgttttaagtcaatatcaagaatatatttatccgacaaaacatgtattagtgggaaaaaattggcaaattttgatgttggatagtcaagtatcaggcgtacctcatgggtatctaggacaatatcaattggattggttgtcagcaaaactgagagattatccaaaacgccatgccttagttgttctacatcatcatattgtttccactaattcggcttggttggatcaacataatttacgcaattccttagacttaatgcaagtgttgttaccttttagaaaagtgcggggcattttatatgggcatattcatcaagcaatggatacaaaatggcagggatataaaattatggcaacgccttctacatgtattcaatttaaacctgacagtaatcatttttctttagacacatcacaaccgggttggcgtgaaattgagttatatgatgatggacgaattgaaacaagggtcaagcggattcaacagaccagttttctgccgaatatgttgagtgagggctattgatgaaaagcgaaaagtgcggtgaaatttttgattttttcaccgcactttgttgttcaagtcatcacaaataacattcgctagaatttcatttctaatgataaagcaaaattacgtccagcagcagtaaagcgttctaacccttttccgctgttatatacgtcgcccaatgcaccattctctttgatttgtcgtaatgtatcccaagtggtgtacttacgattgaataaattaaagatgcctgcatttaaggtaaaatgggaattgaggcgatattgtgcggttaaatcaaatacgacataagaactgcttaaaaaacgataaggtttgggttgcctaaagtcggatacaacacctgtttttttatcaacatccaattgcaagctatttacattcggaatatcaatagcatctttagcttttttagcactgacatatcgcccgctgaagagaacattccatttgtcgttatccgcttggtagcctaatcccaacgtcgtgctaaaaggctggattggtaacattgccgtgccattatttttacgtccttttgcatagcttgcttttaatatagcgtaccaagatttggataaaccaattattttcccgttagcacgggcatggaaatcaagaccggtaacataggctttatcaatatttatctgctgataatttacgccatctaaataatattcagtatatttttttcttggcttggttgtccagtcaattttttgacgagatccgactttcggttttgtttcgacatcaataaaatcccgatattttgtataaaatacagccaagcttaattggtagttgtcgccttccgtggtaagagaaagttcatgattttgtgctttttcaggcttcaaattaatattaggtaaagatatgacatcacttgccccttttaaatcaaaatacatttcttctattttcggtgctttaaaacctgtgctgaattcatagctaagtaacgtggaatcagtgatcgaataatttaatcccaacgaaaaattgaccgcactaaattgtttcttgggtaaaacttcgactttttgactggtgagatcatattttaatgcacttgtggtcggtttatagcgatagtgatcgaagcgtattcctgcatttgccccccatttttgattaatactgattaaatcctgcacataagcgtaccaagcttgacgagcaacaggttgttgaacagtaaattcacgttgttttatccttgaataggcattatactcttgattcctattttctaatttaccccaatgataacccaatccacctgataattgatgacgagcaaacttgccggcaatttcattggcaataaaagaaacatctaattgataatgcttctgttctgttttatataaacgcttgtcagtaataatattataatcttgcggagaaacaccatattgattggaattagcctgttgtgagactttttgttgggctaattgtacgctaaatttatttagccagctttccgttggggtataattataggaaagaccaaatcgctgataaggtgttatatcgcccgcttcttgacgatttgaagcataaaaacttttttctaaaatttttctgctttgctcaagattttcaaaaaaaccttgcacaaaatgttgtggagtaaaatgatatcctaattttgccaaccaagatcggctgtgataatccacattatcaggtaatacacgactacgcccacataattggggaaagatatctcgctggtctccatttggtaaaatgccacaatacgcaacgtcttttagtttgccactgtagtaatttttgttttcatgtgcatggcgataggtgtattgcaacaatccctcggcgttaccctgcttgaacccccccctatcacttggcgatattccgtattacgtgagctataggcagttttagcataaaatccaacagttttattcgagtctacaaaatcatgcacattttttgttcgcatcgacacgctaccgcctaacgcaccgctaccttgtgttaaagaattcgcccctttattaaattctacactacttaagttttcaatttccgtgctgttgcgattaccattataaaatcctttaatatagtaaaagcgaggcatataactttcgaccgcacttattccatcaacactcatcgccacacggtcgctttctacaccacgcatagtataaccattggcaccgccacgccctccttcagtgactgtaacacctgtttgccaacggaccaaatcctgttcgttccataccaaacctcgactaatttgttggctatttgtgcttgaagttttagccgatacttgttctgtttcaacaataatctgatctaatgtagcagaatcattaaattgagcgattgcattaaatgaaaataaaggtaacgtaacagcagaaaaccgcagtaacgtttgctgacgattttgatcaaaaaacataacacccctcttaaaaataagaatcaatcttattaatgataacagagatattactatatcgctattccttcttttatttatctaattggagaaatagaaacctttaaaatagcagaaatataaaattagacctttttcttactaatggtatctatccatactgctagtaataaaatgccaccttttacaatatattgccaaaaagtcggtacatccagcatactcattccgttatccaataaggcgatgataaatgccccgattactacgccaaaaatactgccgataccgccggctaaactggctccaccgataacacaagcagcaatggcatcgagttctgcattttgaccggcagatggagctccggctcccaaacgggaacttaaaattaagccggctattgccactaataagccgttaagagcaaaaatggttaatttaactttttccacggcaatacctgataggcgagctgcatcaatattgccaccaattgcgtaaatatgtcgaccaaatgctgtttttttcgaaatgaatgttcctataatggctaatccacagagaattaatactggaattggcatgcctcgataatcgttaagcagataaattgcaccaagaataaggattgctatcatgccatatttcactgtttctttgggcattttggcaactggtaaatttaggttttgtctggctttacgctgataacttccccaagcaataaagcaaaatattatgatgctccctaaaattatccctatggtgtcggaaagataaccttgaccgataattgtcatatcattactgataggggaaacggtagtaccattcgttaatccgatcaaaattccccgaaatgcaagcattcctgctaaggtaacgatgaaagatggtactttttgataagcaacccaccaaccgctccacgccccgattagtaaacctaagagcaaggtaacaaggatagttaagggtaacggccaaccccaccaaacattactaattgccgcaaagccaccgagtagccccattagtgaaccaactgataagtcaatttctgcagagataatcacaaacaccataccaatagcaagaataccggtgatagcagtttgacgtaataagttagagatatttcttgcacttaaataagccccttctgttgcaattgagaaaaaaaacataatcaccataatggcaatcagcataatatagacttgtaaattgattgatttgaacttattcatagcttactccttaagtgcggcttccattacttgttcttgagtgagatgatggttgattaaatccgctttaactttaccttggtgcattactaatacacgatcgcttattcctaaaacctcaggtagctctgaggaaattacaataattgacatcccttcctgagctagttggttgattaatttatagatttcatattttgcaccgacatcaatacctcgagtcggttcatctaaaatcaaaatgttaggatgtaataatagacattttgctaaaattgctttttgctgattacctccacttagccggcctattgcgagttcaggcgaggaagttttcactttcagtttggcaatagattgattgataatggtttcttccagcggttcgttaatgacttttttaccaaagcagaattgagacaaagaagataaggtaatatttttacctacgctcataataggaataataccgtgttttttacgatcttccggtaccatgacaatatgatttgcgatagcttccgcacacttgttgattttaactttttggttattgagaaaaatgttaccttggtattttcctacataagaaccaaaaatacattgagccatttcagttcgccctgaaccgactaatcctgcaacaccaagaatttctcctttccgtaatatgaaattggcattatcaacgcgtttaatatgtgtattggttgggtgccacgcagttaaattttctacgcgtaaaatttctttgccaatatcgtgtggctcgtgtggatacaatgaggtaatttcacgtcctaccatcatggtaataatgtcatcttcgcttatcccttgtgctaattgagtgccgatgtgttcaccgtctcgaattacacagatcttatcagaaattgcttttacttcatttaatttatgagaaatatagatacatgcgatattgtgagcttgtagacctttaatcagattaagtagaatgtctgtttctttttcggttaatgaggcggtcggttcatctaaaatcaataaacgaacttgtttattcaaggctttagcaatttcaactaattgttgttgtcctaatcccaatgcactcacttttgtatttggatcaatatcgagctgaacctgctctaataaggttttacaacgcagatacattttgttgtcattagtaataccgacttgggtaatttcattccctaaaaacatattttccaatactgacatatttttcactaaagtcagttcttggtgaataatcgaaattcctttttcttccgtatctttaatatttttagcggttaatttttcaccggaaaaataaatttctccctcataatcccctgagggataaataccacataatactttcattaaggttgatttgcctgagccattttcaccacatagagagagtatttcgccggtttcaagggaaattgaaatattatttaatgccacaacatcaccaaattttttagtgatattcttcatctctaataatttcgtcataacttcacccctttttttagtatggcaagacataaaatcttgccacataaaatattttattatttataaacagcctctttggtatggaaaccatctttaatcaccgtgtcatcaatattctcttttgtaacgacgacaggctctaataggaatgcagggacatttttcaatccgttatttaattgagagttggattccacttttccacctttacctaacgcgactgaaatttcggctgctttatctgctaaattagtgattggtttgtatacggtcattgtttgtgaaccgtcaagaatgcgtttgattgccgctaaatcagcatcttgacctgaaatcgctactttgcctgataagccttgagcacttaatgcttgaattgcaccaccggcagttgcatcgttagaagcgactaccgcatcaatattgtttttgtttgcagttaacgcattttccataatttgtaatgctttttcagctagccaagaatcaacccattgatcgcctaccacgttgatttcaccactgtcaatgtgcggttgtaatactttcatttgacctttacgaaataattttgcgttattatcaacaggtgaaccgcccattaagaaataattccctttcggttttttctcaataatgctttgtgcttgtagttcacctactttttcattatcgaacgaaacatagaaatcaatatctgcgttattgatcagacggtcataagctaaaactttaaccccctcttttttggcttcagcgatcacgtttgacaatacttcgccattgaatggaataatcactagcacatcaatatctttatttagcatattctcaatttgagaaatttgagctgtcgcatcaccatttgcagattgaacgaatacttttgcacctaaagcttctgcttttttcacaaaaatatctcggtctttttgccatctttctaaacgtaaatcatcaattgacataccgattttcagatcgtttgctagcactgaatggctaaaaaccattaaagttgctgttgcgaccgctaataacttagatttaagtttcataaaatacctcacttggttgagagaatgatgtaagggtataatgtagttgccccgagtgaagtctgcggagatttggtaataagtgcaattatcagatttattaatgtaattatgttttttcgcttttgtgatctgttcgacattaaccaataatctaaatacaaaaacgaaatatcgtaattgagggttgttttcaattttaagatgatgagccttgtattcatatttatcacatctcagaggagacttggctatgtctaattattttgacaaaattgcaaaggtaaattacgaaggagcaaattccactaatcctttcgcttttaaacactacaatccaaatgaagttattttaggtaaaacagtagaggaacacttgcgtctggcagtctgctattggcacacgttctgctggacaggtaacgatatgttcggtgccggttcattggatcgtagttggcaaaaaacaggtgatttgctggttggtgcaaaacaaaaagcagaaattgcttttgaatttttccaaaaattaggtgtgccttattatagttttcacgatgtagatattgctcctgaaagcgataatttcaaagaatatttacataacttcaatactattgtggatattttagagaaaaaacaatcagaaactggtgtgaagttgttatggggaacagcaaactgctttactaatcctcgttatatgtcaggggcttctaccaaccctaatccggaagtatttgcttgggcagcagcacaagtttttactgcaatgaatgcaactcaacgcttagggggtgaaaactatgtattatggggcggacgagaaggttatgaaacattgctgaataccgatctcaaacgtgaacgtgaacaaattggtcgttttatgcaattagtggtagaacataaatataaaatcggctttcaaggtacattactaattgaaccgaaaccacaagagccaactaaacatcagtacgattatgatgttgcaacagtttatggttttttaaaacaattcggattagaaaatgaaattaaagtgaatattgaagctaaccatgcaaccttagcagggcatacattccaacatgaaattgcaacggcaacttcattaggcattttcggttctattgatgctaaccgtggcgatccgcaattaggctgggataccgaccaattcccgaacagcgtggaagaaaatacgttggcaatgtatgaaatcctaaaagcgggtggtttcaccacaggcggtttcaactttgatgcgaaaattcgtcgccaaagtaccgacccatatgatttatttcatgcccatatcggtgcaatggatgtgttagctttgtcgctcaaacgtgctgcaaaaatgattgaagaccaaacgttacaaaaagtggtcgataaccgctatgctggttgggatcaagagctgggtcagaaaattctaaatggcaaagcgagcttggaggatcttgctaaaatagtagaaactcaagggttagatccaaaacctgtttcagggcagcaagaatatttagaaaatttagtgaatagctatctttatcgttaattctgacaagcggtctttttttgcaaaattttgcataaaatgaccgctctttagattaaggagtatttatgtacattggaattgatcttggtacttctggggttaaagttgttttacttgatgaaaatcaaaaaattattgccattactcaaaaatctcttcctatttctcgccctcaacccttatggtctgaacaaaatccacaagattggtggaatgccactcacgaagcaatgcttgaattagctgataagcaaaatttaagccatgtaaaagctattggattaactgggcaaatgcacggtgctacattactggataaggcagataacatactttctccggcaattttatggaacgatggacggagctttgctgaatgcgaagagttggaaaaattagtgtcaaatagtcgtgaaattacaggtaatttaatgatgccaggctttactgcacctaaattatgttggcttaaaaaacatcagcccgatattgccaaaaaagttagtaaggttttgttaccaaaagattatttacgatttttaatgacgggagaatacgcttctgatatgtctgatgcctcaggcacaatgtggctggacataggtaaacggagttggaatgaagcacttttgaatgcttgtggacttgatttgaataatatgccgaaattatttgaaggtaatcaaatcacaggttatttacgcaaagaaattgcacaacaatggaaaataaatgccgtacctgttgtggcaggtggcggtgataatgcagccggtgccattggtataggactttaccaagcagagcaagcaatgttgtcactcggtacttcaggtgtgtattttgtagtaagtgatacattccgtgccaatccacaaaaagcagttcatagtttttgccacgcactgcccgatcgctggcacttaatgtcggtgattttaagtgcagcctcggctgttgattgggctgcaaaatccctaggctttaaagatgtaccaaccttatttcaacgagttgaagcaagccaaaccgagtccaatgtcatattcctgccttatttatcaggcgaacgtacaccgcataatgatccttatgcgaaaggtgtattttggggattaagccatagcgataatcaagttacgatggcaaaagccgtcatcgaaggcgtgagttttgctatggcagagagtattgatgttttacatgaaacaggtgttactgcaaataatattgcgcttattggtggtggagcaaaaagtgcttattggcgacaattacttgctgatattagcggtaaaacatttgaatatcgtacaggtggagatgttggcccagcgttaggtgcggctaaattagcacaaattgcattaaatccagaacaagatattgcgaatttctgccgaccgttaccattggaaaaaatctatcagcccaattctgctcgctatgcagaatatcaagctaaacgtgagaaattcgcagagctttatcaacgagtaaaaggtctacctttgttttctttgtaaatcaaagacatataaggcttttcttgatctaaaagtgcggtgagaataccgcacttttaggggtatattttggatacaaaaaaacggcgataacaacactgctatcgctggtttagttttatataataaattagttaaacacaccgctgatgccgacacggaaacctattcgaccacggctgtcggaggacataccgccggagacagcccatttaccatttgcggaagttctgccgaggtttaaagagaccgcactttcgctgctataatgagcggcaccggcggcataagaccatttwcccgggacgaaaggsacktctttraaagccatmgcggcggcgataccsgctttrgcgtctttgttgacytcttcaasacgttggttngtkgcgtgtaattgrctrccgttkaccgcatcrgtkgakygatgagaaagcaaaccagcrgcaacattttgaatacggcgttcattgcctttgytgccyacggaaacgaygcctttagcgtcagcaccggcataattgccgtcractttaccgataccgcctgaarywtcgctttgggcggtatatctggaaccatcgcctagaaacacagaattatcagtggtaacatcaatattattacctatggcaactgttttggtgccgttattcttaatattacgacccattgagaaagaattatctttggttgtatgtacaccrctaccaaaacttagtgaaccttcgcctgaggctgttgcttgcggaccgatggcttgcgatcgtttaccactagcagttgcttgccaaccaagtgcggtagaggcttctcccttcgcattagcagcccaaccaaatgcagtactatattcaccctctgctttagctcttgcaccaaatgccgaagataatttgcttgctactgcttcatcacctactgctactgcaaaatttccagttgctttagaatctttacctatagaaattgcctgcgtacctgcatttgcttggaagcccattgctacggcataagattgtgcctttgctttcttaccaaccgcagttgctccttcatgtgcagcatttgcttcaaagcctacagcgacaccagactcagctactttggcatcttttccaacggcaacggatttggtaccayyagtataagttccttctgccttagtaccttcaccaatataaacatgcccattactaayatsawtattaccactatttgattgttgagcttgagccatagccgaatgagcagttaaarcaactaccgcagttaaagataaataaaaaattttcacttaaaagaaatccttaaaaaaagagttaacatagaaaaatcataaaaaarctaaccgcactaagaggcgataatttatgacacgccttaaaaagaggtagggggacctaccaaagcgggcgaaattttaagcggggggggggtactgtcaatatatttttttacaaaatatttacgtatttaacaaaattgaaacggtaaaaaacatttgtcgaacacggaaaaatattcatttgtttttgtgttatggaatgcagtagaaagaagaaatgaagttgcgtaagtgatttaaacgctccacgcattttcatctagtacttgtccaaaatgactttcaacgaggcgtttggttatatcgctttgtggttgggtaaagattgtttttgtatcgccatattcgatcatttgtccttcgtccatcactaatacatgatcggctatgtgtttgatgatgcctaaatgttgacctacataaatataagagatgctgagtttctcttgaatgtctaacatcaaatttattaattgagttttgactgtcgcatcaagtgagccgagagcatcatcggtaataataatttccggtccaagaataagtgcacgcgcaatagcaacgcgttgtttttgaccgatggacatggtattaatttttacattggcatgttcgggataaagtcccactaaacgtaatgtttcagctattttaagattacgttcattttcgtttaggttggttgtcaggcgtagaggtgcatctaaaatttgtcctacatttaaacgaggattaaaggcagaataggggtcttgaaagaccatgcgaatatgttgtgaacgatattgataatctccgtactctaagggatttcctttaaatagaagttcgccagatgtgggttttataataccaacgatcattttggcaacagttgattttccggagccatttttaccgataatagccaatgttttttttcgtgccaaaacgaaactaatattttctacagctttaaattggcttgtgctgaagataccaatattatcattaaaaaattttgataaacctgaaacttccagtaagttcatttttacttcccgttcttattttgttgtgtttacgactaatgggccagtttccatttctttttctctacgttgactttcttttaaattaatagggaaatggcagaaaaattcatgttgtttaatccgttgtgcggttggttttcgaatacattctttttgtgcaaaaggacaacgtggacctaaacggcaaccgataggcattccttctaataatggaacagtaccttttagcgtactcaaacgacttttatgtactaagggctgtttaaaatcaggaatagaatgtaataatgctcttgtatagggatggtgaggattttctaaaatgttttctttagatcctgattcagcgttttgtccgcaataaagaactgaaaaactatcacaccatgcactaatactatttatatcattacttaccagcagaatacttgttccctgattttgattcatactggcaagtaaacgaaatatttgtacttttgtcattgactcaagagaatttgtaggttcatcagcgattaataatcgaggttggtttgcaattgcaagggcaatcataattttttgtccttcaccttcagttacttcatgtgggtaactttgcataatatctttatgatctttcacacctacacgatgtaataattcaatagcacgacgttttttccaaccgaaccattgccaccatcgccctttaaatgtccaagagggaatgctctgaataagttgttgtccaatttttcggctaggatctaaagatgctaaaggctcttggtaaatcatggagatttctttacctaccagtttacgtctttttttgggatttagttttagtagttctacatcgtcaaaacgaaaacgatcggctgtaataatccaagaatccttaattgcattacaaataactttagcaatcaggctttttccggaacctgattcaccgactaaaccacagatttcaccttcatttaaggttaaattaacattatcaataattttgaatcgtccttttggtgtttctatttcaatacaaagattacgaatatcaagtaaagccatgtcggttgtccttatccataatatttttctatggctttacaaagcccattagtcaaaatgagaacgataacaatggtgatgataatagcaacaccgggtaagattgttgcccaaggggcaagataaattaattctatataatcttttatcattgttccccattctggcgttggtcgttgtgcacccaacgaaataaaacttaatgcactaatatcaataatggcaatgataaatgctctgctggtttcatgaatataacgaataataatattaggtaaaatggtttcttttacaagttgccaattacttgcaccatcaagtcgcagcatcaaaatgtattcttttttcagttcttgttgtaccgcttggtaaatttcatgaataaaatagggaagtaatgcaagcgtgatggcaagcattgcattgattaagcttggttgcattaatgtagcgataataatagcgatgagtaaaatagggattgataagaaaatatcaaaaaaatgtcctaagactcttgcttttaacccttgtgataatcctgcccaaataccaagaattccacccaaaatagatgtgaataatacaacaatgagggcggcaccaaaagtgtaagttgtacctcgaatcaaacgactaaaaatatctcgtccaatatcatcagttccgaaaaaataggcaatttttccgttatcagcccaagagggggggagtaactcaaaaccaataaactgtgctgtatcactataaggtgcgataaattgactgaaaagtgcggtaataatgagtaataaaaaaagataaaagccagttaatgccaatttatcttggtagaaaaatttccaaatatgttttaatccttgtgtttcgcgaaattcttcaggttctttatctagcataccagttcttcttattaaatgggtccaaaataaaggataagaattcagtaaataaattcactgcaataatacaaagcccaacaacaataatgcctattgaaatgctattatagtcttgttgtttaaccgaatctattaaccaatgacctataccaaaccaaccgaacgtgctttcaatcagcatacattgagccataacaagagtaaataaacgactcatttgcgggatcatgataggtattgtgttacgtaaaatgtagatttgtagaatttttctttttgaccaccctcttgtttctgcaattttgacataactttgggtgaataaaaaatcagctcgttgctgaacgattctaataatatccatagttggtagaattgcgagaactaatgtgggcaacacaagatgttgcaaaacattttgaatcattttaatacgataaggctgatccgtaaaccaaacatcaataataggaaagcctgtaatgggctttatctcatacaataaattatactgtccaattgctgaaatttcccaattttgaatagctgaaaagtacaacaagattggtgctaaccaaaaaacggggatagcaatacctgtgatatagaaagaacgaatagctttgccacacaaatgatctgcatataatgcactgagtaatccaagaggaataccgaaaattaatgctaacagcattgcactaacacatagctctaatgtaggaggaagtacagcaaaaatcaattcttttagtgattctccgccgtggtaagtaataccaaaatccccttgtagtaaattttgtagatagaaaaaataccctgaaaaaaagtgcggtgttgctagcacttgatttaatggatctttgagcaggatgctgtaactgatgagagataaaataaacagcgtgctgataactaaaatgcagtgacgaaaaaaggaaaatagcattgttttattacctgtttataatttctattattttttaaatgacagttttgaaaaattaatattgccaaacggcgttaattcaattccctgtacttttgcatttgctaacagaacacgttttacgttagcaataggaagaatagggatttcggataaaataatttcttgtgcgatattataatattttgcacgttcacgtaagttcgatgcggctaatgcttgatctaaggcgtgttcaaaaggtgcatggcaccaatttgaaaaattagttatttcgttttgtgtaccgcaacttaaaatgggacgcataaaactatcagggtctagatttcctgctaaccagccagttaagataatatcgtaatcctcagtttgttcttgaagctgttgcattaaataagtgcgggtaacgttacgtatatttacattcaccccaaccttaattaaatctgctttaattaattcagccatttttattggcgaagggttatacacttgttcttcattaataacccacatatctagatttatattttttcctgcaaagtattcctttgcttttttgacattatagtcataggcaaaatcagttgtatttacaactgccccccaagatattgatggaataatattgttcgcaacacttgctgtattatgataaatcaggttaataatacgttggcggttaattgcatgagcaatatggcgacgaatctccagatcttgcataagtgttttttgaaagttaaatgcgatataagataaattcatgccttcaattgattttatataatatttttcatcattgtgacgcaataaccctaattggctcagttccggataagaggcgatatggcattcattattgaagaatttaattaatctgcctgagcgattagtggaaagatcaatgatcacgttttccaggtttacatttttttgccaataattagggttatgaacaagacgaacatattgattacgaaagtaatctttaacctgataaggacctgtgccgacaggtaaattatctaattgcactaaattgtcgtctgcattgagttgcaatgcgtattcttgagaaaaaataatggcgtattggctggctaggtgagaaagcacggaagcatcgggtttaaacaagataatttgaatttggtaaggattgattgctttcacttcctgaattttttcatttaatttaatgctgtcaaaataaggaaaatgcacttttttacgttgttcgtgatagaccttatattgtggatttttatagtgaagagtgttttgatctaattccggtagtgcgatattctgaccgagtatgcgatttaatgaaaaaaccacatcttccgcattaaaatcacggcttggtgtaaaccagtctgtatgatgaaatttaacgcctttgcgtaaattaattgtaataattttcccatcaggtgagatactataggattttgccaaaactggttcaagagttgcactatgatttttaatttcaaataatttattgtaaatttgctccgtgactatattcatactggttccggcatctgcagtttgaggattaaaggaaaaactgcttgcattggtacaataaatcaaaccgttgtcagtgagtattttgggtattttgggtgcactaaaagagggtaaactaaagagtagcccatagaagagtgtacataatataaaaatcttttttgccaacataacttaattaattatgataaattatatgggaattgtaaggcatattaacgcaatatagaaataaaaatgtttaattttatccataaagaacttgatgaactcattaatcgtggaatggaccgcactttacgcattgccgttacagggctgagtcgtagcggtaaaactgcttttattacaagttttattaatcagctattacatattaattccattgacaataaacatattccgctatttttacctgcacaaaataaccgtcttcttggtgtaaaacgtgttgaacaacgagatctcagtgttcctcgttttgactatgaacaaaatatgaaagcgttaaagcgtgagcctgcaagttggtttaaatcaacggagagtgtcagtgaaacacgtttagccattcgttatatacgtaaagatggcttaatgcgacatttaaaagaaaaaggcacattatatgtagaaatttttgattatccgggtgaatggttactggatctgcccttactggatttggattttcaacaatggtctttacagcaacaagagttatttattgagcaacgacaagaattagcacaaaactggctgaataagatccgcactttagatttaagtgagccggcaaatgaagagatgttggcacaacttgcccaagactatactgaattcttatttgcttgtaaaaaacagggatttcatttaacacaaccgggacgctttgtgctacccggtgaattaaaaggcgctccggtattacaattttttcctctggttcatttaactgagcaagagtggaaaagactaaaagagcggtctaaatctgacagttattttgcgatgttgagcaagcgttatcattattatcaacaaaaaatagtgaaaggtttttatcaagaatatttttctacttttgatcgtcaggtgattttagcggattgcttaacaccacttaatcatggtcgccaagcgtttcaggatatgcaaaatgctttacagcaactattcaaaaatttccattatggcaagcgaactttattcaatcgtttgttttcgccaaaaattgataaattaatgtttattgcgaccaaagcggatcacattacattggagcaatttccgaatttagtgagtttaatgcgtcaattagtacaagagggagggcgttacgtagaatatgaaggaatagatactgaatatactgcaatttccgccattcgttctactcaacaagtacaagtaacgcaaaatggacaaaagatcaaagcattacaaggaattagatcaatagataagaaaaaaattgttgtatatcccggaagtgtaccgagtaaattgcctcatgcagacttttggcagaagtatcattttgcgtttgatcaattcgaacctcttacagtggaaaatggtgagccaatcgcccatttacgtatggatgctgtcttacaatttttattagcagacaagttagattaggatataaatatgcaaaaaaaggtttttcaacaagaagatgttgagcaaaaaatcacagaaaattttgagcctaaacaagaatttgagcaagacgaattagatatagaaatggactgctctcaatctgaaacaacaatggatcggcaaaatacagatattcattttcagcatatggttagaccaaaattgacaatgtggcaaaaattgctcatggctacgatctgtttgtttagctgtggcattttggctcaatcggtgcaatggttggttgatagttggcgggataatcaatggattgcttttgtttttgctatggtcagtttatttttggttttgttagggcttggagcaataataaaagaatggcgacgtttagttcaactaaaaaagcgtttgatattacaagaaaaaagccgagaaattcgctcaaaaagtgcggttaatttaactgatgtttcttctgagggcaaagagttgtgtttaaaaattgcctcacttatgggaattgatgataaatcgccacaactcattgcttggcaagaacaagttcatgaagcttacactgaacaagaaattctgcgtttatttagtcaaaatgtactaataccttttgatcgggtagcgaagaaacttattagcaaaaatgccgttgaaagtgcattgattgtggcagttagccctttagccattgtagatatgttctttatcgcttggcgtaatattcgtttgattaatcaattagcaaaactttatggtattgagttgggctatgttagtcgtctccgtttgttacgcatggtttttgttaatatggcatttgccggtgcggcagaagtcattcaagatttcggtttagaatggttatctcaagatataacagcaaaattatccgcacgagttgctcaagggattggcgtgggcatacttactgcacgcttaggtattaaagcgatggaattttgtcgccctatagccgttgctccagaggagaaattgcgtttaagtcatatccaaacagaattattgggaacattaaagacgactttatttagtgccaataaagtgaaagagaaagtgcggtagaaataatttattagcttcaaaaagcaaagattatatacataaaatctgcactttaataagtctgtcaaactgttagagtgcagattaaaatgaccaatttttactcttaagcgacaacattaaattgtgctttcatcaatgcttcgaaatctgtgcaaccgccaataggtttttcatcaatgaaaatttgcggcacagtttctaccggtttaccgacagacaatgatagatccgctttactaataccttcagcaacaatatcaatataacgataatcgaagtcttcaagggtattttttaatttttccgctaagttttttgcacgaacacaatacgggcaacctgaacgaccaaaaataacaacgtacatatttattttcctttttgttttgttaataaaaaagtagcgatattctaactcatttggtacaagatttttagcattgttacaacgaaaaaagcctatttctatcaatatcagaaattattcctaactatcaataagttcaatagtcacaccgttatgtaatcctctcggcagaggcgatcctttgcgtcctcgctcagcacgaaatttttgtatatcctccggttttaaggtgacttttcgttttccagcatgaaagacaagactggttttttcgctgatcaagaataatttgaccaataattctgaccgctctttagcatttgcagcgggaatatgaatgattttgttgcctttacctttggataattcaggtaagtcggcaacaggaaaaaccagcattctattcatggaagttaaagcgaccaaaagtgcggtagaattttgcaaaactaatggaggtagtacgttggcattttccggtagggaaataaccgcttttcctgccttattgcgagataccaaatcttcaaatttacaaataaatccatatcctgcatcagatgccataagcaaagattgattttcgttttctatcagtaaatgttcaatagtagcaccgctaggtaaggtcaattttcctgtaagcggttctccctgtgatcgggcagaaggtaaggaaagcggatctaaagtgtagctacgtcctgtgctatcaataaagaccaccggctgattgcttttaccgcaggcatgggtcaaatagttatcaccggtcttgtagctcaaagctcgtgcattaatatcatgtccctttgcacaacgtacccaacccatttccgataagataattgtaatcggttcgctcggtgtcatatctgtttcagaaattgcttttgcctcagcacgttctactaaaggcgataggcgagggcttgcgaaagttttcgcatcttgctgaatttcttttttaattaaattatttaagcgaatttcagagtttaatatttgctctaaactgttccgttcttttgctaaattatttttttcagcttgcaattcttgttcttctaatctggctaaatggcgtaagcgtaaatttaaaatcgcttctgcttgttcatctgttaaattaaagcgtgcgatcaatatttctttaggcttatcctcattacggataatttcaataatctcatcaatatttaaaaaagcgatgagtaagccttctaaaatgcgtaaacgagctaacactttatctaaacggtattgtaagcggcgagtcaccgtttgacgacggaaggttagccattccgttagaatttgaacaagattttttaccgcgggtttattgtccaagccaatcatgttcatattaacacgataacttttttctaaatcagttgtggcaaataaatgtgccataagtgaatctgtatcaactcgatttgatcgaggaacaatcaccagtctaattggattttcatgatccgcttcatcacgaatatcttctaccattggcaattttttattctgcatctgctcggcaatttgtgccacaactcttgacggcgaggactggtgaggaagtgcggtaataattatttcaccattttcttttttccagacggctcgcattttgattgagccacggccttgttcatatattttacgaatatcttctttcggtgaaataatttccgcttcagtcggaaaatcaggaccttgtagcacggtcattaattgatccaaagttgcattaggattatctaacagcataattgtggcatcggcaacttcattaagattgtgcggtggaatatccgttgccatacctacagcgattcctgttgtgccgttaagcagaatatgaggcaagcgtgcaggtaaatattgcggttcttctaaagtaccatcaaagttggcttgataatttaccgtgccttgtcctaactcggataataaaatttccgaaatttttgacaagcgagattcagtataacgcatggcggcaaaggatttaggatcatcaggtgccccccagttgccttgaccatcaacaagaggataacgataagagaaaggttgtgccatcagtaccattgcttcataacaagcactatcgccatgcgggtgaaatttacccaacacatcaccaacagtacgtgcagattttttatattttgcactcgcattgagtcccaactcagacattgcataaataatacgacgctgcactggttttagtccgtccccaataaaaggcaaggctcgatccatgatgacgtacatggaataatttaaataggctttttccgtaaactggcggagtggcatttgttcaatgccttcgtagttgattgtgttcatatggttgtttttcgtttatttaatgaaaataaaaatgtatttaaactatgattttaaaatcatatcgtcaatattatcctgaaagacaaatttacgatgataatcaaggtatttttctcttccttcaggataaattcgcattttatttttcgcatttgggttgatatgcaatttctcccaagtataaatgcttagttgtgtaccgcagattagctcgccattatccgtaaatgtgatatatccctgatcaaataaccaatcgtatgtcggagtaagagataaaccattcaaatgatccaatgcctcattttcttttccttccgagatacaaacactgtaaggtttgatatggcttgcttttaataacacatcatctttaattaaagtaaatgggcattgtggcatataatctaacacttttctgcgatattctgactgcccttttcgccctgtccgtttaactgcacctttattttcatcaattaatttttctgtcatttgcgatgatgattcagtaagttttggatgaacaatggatctaaattgataatctaaaaatactctgaaataaaacaaaggtttttgctcttttccttgaattttctctggaagtagtttcaaaatagataaatagctaattttaggaagaattaatgctcgccatatattccaaatatcggcatctgaacgaatataacctctacgacgtgtaggattaccagtgactaaatcagacacatcataaattgaaaattcatttatctcattttttaaatcaataatagaatttaagtaatcattataatattcggaaatatctgtgtgataatgttgttcttgtttgtgaaattcaactctagcatcatagagatatttcaataggttgcttttactaaaaaaacaattttcttgaatagttggatattctgctctcttattgttaacttgtttagctgcccccctgttatgatactcaaaaaaatcacttaatctagaaccgctattgccaacataactaccgacatattttcgtgcttcaccattccctgtaaaaatggataatttgtttttacgatgaataaaactatcttccgcacgtaaattttgaatagcatcaataataatgtaattttcgccattaacatggattttttgaaatttttgcatattcctattctccgtattgtgtaatatccatttgttttagcaatgcgattaacacatcaacgacaatactatttcctgcttgtctgtatgtttgagtgtcgctgacgacaatttggaaatcatctctaaatcccattaaacgtaaacactctcttggcgtgagctttcttattcttccttgattatgagtaacataattatcgacgccggcacggtgcattttgtgcattgtttgtaataaaggacgagccactgataaatcagtttgtgtactcgttttgaaattctttgttccacctgctaaaacataatcacgaattttgctggataaataatatttttcttcgacatcattaatgttaaaaataaactcatcaaaactgcttttatttattttgggcacaaaaacaaaatcaccatgccaattaaattgttggttggctttttgacataacattatatcgccattaatttgcgtatagcgtttttgccgatttttagaactggttacaaatttaatgcctttttctttaagaaaatatttgctatcagtgtaatcctctagaaaatcttgcatcgtacgctctaaaggaatcttagttggaaattggaatccgccttttggcgaggttttaaatcctacaacaaaaatacgttcacgatgttgcggaataccataatttttgctgttcattacttgaaaatataaattgtagcctaagctatggaaaacatcttttactacttgccaagtatttccaccatcgtgatttaataacccttttacgttttcataaataaagacttttggttgagtctcatttaccactctcgcaaaatcataaaaaagcgtacctcgagtatcttccaatccgtgtcgttttcccaccatagagaaagcctgacaagggcttccacccactaaaatatctacttgatcacggtaaggtatcgcatcaaaagtggtaatatcagaatgccaatgttcttcagataaatcgtaattggctaaataactttttttaacgtggggatcaatatcgccagcaaaaacaatacagtgatttagttctaagcgtttgaaagcttgttctattgcaccaataccactaaacgtcgtggctaagcgtatttttgcattaggatttttaaatgttttaaaacgccaatcacactcatcaaataagggtaattcaaaatttaggtttgttttatccatgagatttgtcatataaatataaaataaattttctatttttagagagtactcaaccaaataattcacacagcaaaatctacttgatcaccgttattttgcaaccaaattttccgatcttcggaacgttttttagctaataacatatccatcaattctaacgtagatacatcttcttcgtggggttcgtaggttaattgcaccagacgacgagtgtttggatccattgtagtttcacgtagctgattaggattcatttcacctagccctttgaaacgctgaacattgagtttgcctctcttattttttaagcgtgccaaaatgctctctttttcgttttcatcaagagcataaaaaacttcattacctaaatctatacgataaagtggcggcattgcgacataaacatgaccattttgcactaattttggaaaatgacgtaaaaataaagcacaaagtaatgtagcgatatgtaatccgtcagagtcggcatcggctaatatacaaactttaccatagcgtaattgagataaatcttcgttgtcaggatcaattcctaatgcaatagcaatatcatgaacttcttgtgagcgtaacacttgatccggtgaaacttcccatgtgtttaaaatttttccccgtaatgggagaattgcttgatgttcacggttgcgagcttgtttggctgagccaccggcagaatctccttctactaaaaaaagctccgttttacttaaatcttgttcactacaatccgctaattttccaggtaaagcaggaccactgactaattttttacgcacaacttttttcgctgcacgtaaacgtctttccgctgaacttatcaccatttttgcaagttcttcggcatcttgaatattttgatttagccataaactgaaactatcttttacaacgccgccaacaaagaccgcactttgacgagaggaaagtcgttctttggtttgacctgcaaattgtgcatcgtgcatttttactgacaaaacataagcacagcgttcccaaatatcatcagcggttaatttaacatttttgggtaataggttacgaaactcacaaaattcacgcatagcatcaagcaaaccttgacgtaagccattgacatgagtacctccttgaatggttggaataaggttgacataactttcgttaagtaattcgcctccctcaggtaaccataataatgcccaacttgccgcttctttattcgtcgtaaaatcaccgacaaaaggggtttgtggcaagaggttataaccattaacattttccattaaataatcagataaaccgtcttggtataaccaagtatcctcagtgttattgattttatcgataaatttaatttctaatcctgaacataaaactgctttagcacgcaataaatgacgtaagcgactgactgaaaaattagcactatcaaaatatttcggattaggtttgaagtgaacggaggtaccggttgtacgctttccgcaagtgccgataatctctaattcttctaccttaacgccgttttcgaaggcaattttatagatttcaccgttacgttttacctgaatatctacacgctcagataaggcgtttactacagaaatacccacaccatgcaaaccacctgcaaattcatagtgcttattggaaaattttccgccagcgtgaagtttagttaaaataacttcaacaccggatactttttctgtcgggtgaatatcgacaggcattccacgcccattatcaatcacttctagagattggtctttatacaaaataacttcaattttggttgcgtgccctgcaagtgcttcatcaacactattatcaataacttcttgccctaaatgattagggcgagacgtatccgtgtacataccggggcgaagttgaacgggttcaagatcttttaaaacggttatttcttgtgctgaataatttgtcataatgccatgtgatcagtaaaaatttggagaattttaacaaaaaaagtgtcacctttcatcttgattgttgtgtatcttcttttgaattccaaggagcaacccagaataggcaaagcataccgggaatggctaaccagaaacaaaaccaaaaatagtcatagtatcccaagtagttgattaaaacgcctgcttgtgtattgaaggtaactcgaggtaaggcggcaaagctggtaaataaagccagttgagtggcggtataaagtggattggtttctcgtgccataaaggcgacaaaggcagacgtacctaagccaataccaatatattcagcggcaacgactaaactgagagaaatcagagcaaagttatctatttcttgaaatggacctaattttgccaaccatgcaaagcctaaaattgttacaatttgtacaacaccaaaaagccataatgcacgattaattccgattttcagcatgatgacaccacccacaatactggcgatgagcatcggccacaaggaagaatttttgaccactataccaatctgagtcatgttataacccatatcaaggtaaaacggggaaataagagcggttgccatactatcgccaattttatagagaaaaataaaagcgagaataccaagagcggaagacgtgcctttgcgtgtaaaaaattctttgaacggttcgatcacattttcttttaaagtgcggtcattttttagctgaatttgaggttctttacttaaaaataaggtcataaaaataccaggaagcatgaagagtgcggtaattaaaaagacagttttccaaggtaaatagtctgccaaaattaaagaaagtgagccgggaacaagccctgcaatacgataggcatttacatgaatagaattacccaagcccaattcacgatcagagagaatttctcggcgataagcatcaagtacaatatcctgacttgctgaaaagaaagacaccagcactgcaatacctgcaatcagttgtaaattaaaggaggagcttggttgtaaaaaaccgaataaagcgagtgaaatgagcagtaaaacttgcgaaatgagtaaccaacctcgacgccgtcctaaaaagggcggtataaatcggtcaagcaaaggagaccatagaaatttccaagtaaaaggaagcgttgtagctgtaaaataacctaaggtttccagatctacgtgttctttacgtagccaaagtggcaataaggaaatgataatataaaaaggtaatcctgagctaaagcctgtaaacacacaaataagcatattacgactaaagatttgttgcagaattgagtgagatttttccataatttttccgtatgtataaattttttcaacagtatagatgattttttcacgttcatgataggatttttttattcacataacaagtagataaaatcttttacgcaaacgtttactatttgaaagtttcaggtaaaatacgtgcactttttttattcattttaacttgcctataggggacgctatgtctttagaaaaaacttttgagttgacgaaacgtggttctaacgtacgtcaagaaattattgccggattaacaaccttcttggctatggtttattcagtaattgttgtaccgaatatgctgagtgcagcgggatttccggcagaaagtgtgtttatagcaacttgtttggtagcaggattaggttcaattttaattggcttatgggcaaatgcaccgatggcgattggttgtgctatttcattaaccgcctttactgcatttagcttagtgttgggacaaggtgtgagtattcctgtcgcattaggtgcggtatttcttatggggatagtctttactttaatttctgcaacaggtattcgctcttggattttacgtaatcttccgtcgagcattgcacatggtgcaggtattggtatcggtttatttttgctacttatcgctacaacgaatgtgggtattattgtagccaatcaaaatggcttattagttaagtttggtgattttacgtctttctctgtgctgatgtctttggttggacttgctgtaattattggcttggaaaaaatgcaagtcaaaggtgggatcttatgggttatgatcgcaattacgatcgcagggcttatttgggatcaaaatgtacagtttaaaggcgaaattttcagattaccgacttttggggaacaatccttgtttttggaattggatattatgggtgcattacaaccggcaattttacctgttgtttttgccttagtaatgaccgcagtatttgatgcaacagggacaattcgtgcagttgcaggtcaagcaaatttattagacaaagatggtcaaattatcaatggcggtaaagcattaacagcggattccgtaagtagcttattatctggggcacttggtaccgcacctgccgctgtatatattgaatctgccgccggaactgctgctgggggtaaaacaggtatgacagcgattgttgtcggtatactgtttttattaatgctatttttccagccattagcaagtttggtgccaaactatgcaactgcacctgcgttaatgtacgtaggattattaatgttaagcaatgtcagcaaacttgattttagcgattttgttggagcaatgagcggactggtttgtggcgtatttattgtactaactgccaatattgtaaccggaattatgctaggttttgcaactttagttatcggtcgtttagtttgtggtgattggaaaaaacttaatgtaggtacagtcatcattgccattgttttggttgctttttatattggcggttgggcaatttaattgtatataaaatgttaggtgggtaagcttagtcagctctcgaaagtatccacaaaaaaccagcgataacaacactgctatcgctggtttagttttatatgatgaattagttaaacacaccgctgacgccgacacggaaaccgaggcgaccacggctgtcggaggacataccgccggagacagcccatttaccatttgcggaagttctgccgaggtttaaagagaccgcactttcgctgctataatgagcggcaccggcggcataagaccatttaccygggacgaaaggcacgtctttaaaagccatcgcrgcggcgataccsgctttrgcgtctttgttgacttcttcaagacgttggttagtkgcrtgtaattgrctcccgttkaccgcatcggttgattgatgagaaagcaaaccggcggcaacattttgaatacggcgttcattgcctttgctgcctacggaaacgacgccttttgcctcaacgccrgcatagttgccgtcaactttaccgataccgccggtagtatcacctttttctacataggcagaagaatcacctagaaatacagaattctcggcagtattttggatattatttcctacgacaacggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgcgttagcttcattacctaatgctaccgcaaactttccttgtgccttggatttgttacctatagaaayygcctgygyacctgcatttgcttggwagcccattgcnacggcataagnttgtgcctttgctttcttaccaaccgcagttgctccttcttttcctgcatctgccttataacctacagcaaccgcggactcgccgacttttgagctttttccaatggcaacggctttgnnnnnnnnnnnnnnnnnnnnnnnnnnnnnnnnnnnagtattttcaccaatataaaccccacykttttcaatcttaatatgattattaccaytayttgattgttgagcttgagccatagccgaatgagcagttaaarcaactaccgcagttaaagataaataaaaaattttcacttaaaagaaatccttaaaaaaagagttaacatagaaaaatcataaaaaarcaaccgcactaagaggcgataatttatgacamkmmtwaaaaagaggtagggggayctaccaaagcgggcgarattttaagcggggggggggtactgtcaatatatttttttacaaaatgtttacttttttaacaaaattgaaacggaaaaacatttgtcgaacacgaaaaaatattcatttgtttttgtgttatggaatgcagtagaaagaagaaagaaaaaatgaaatgataattggcggaacggacgggactcgaacccgcgaccccctgcgtgacaggcaggtattctaaccagctgaactaccgctccgcaataaaagaaataataaggggaaatttggcggaatggacgggactcgaacccgcgaccccctgcgtgacaggcaggtattctaaccagctgaactaccactccgcaaaagtggagtgcataataatagtgaatagatttttcgtcaagttatttttatttattatgcacttatttttgctaagtgttgattaagcaaacattaatgcatcgtttcttttgtatttcgcttaaaccataagcaattttctttgcttttttggtttagcaattttagataatcttggtgagccagtttttcttcttctgtgggtaaaagtaatttgaaattatgagtattggtagtatgttgatgaatattttcttccatcgttataatcggcgtatgttcttcatcaccaaataaactggtttgcccccctgtcatggctaaataaacatcacctaaaatttcagcatcaagtaatgccccgtgcaatgttcgtttactgttatcaatatttaatctgtcacaaagtgcatctaaactattacgctttcctggatacatttgacgagccatttgtaatgtatctgtgattaagcaaatatccgctgtattgatattgaaattgtgttttttaaactcataatccataaaaccgatatcgaaaggtgcattgtgaataatgagttcagcccctttgataaaatcaataaattcctgtgcaatagctgaaaaatccggtttatctgccagcatttcatcagtaataccatgtactttaattgcttcaggatcaacgagacgatccggttttatgtaaagatggagttttcttcctgtgtagcgacgattgatcatttcaactgcaccgatttcaataatacaatgcccctcataatgtgcaccgaattcgttcattccggtcgtttccgtatctaggataatttggcgattttgtgtgatttctaatgtcatactattttgctgttgcttgaaatgaatttgcggtattatcgccccatttgagaaaaattagtagaaaattatgttaaaaaaaattgaaatttttaccgatggatcttgtttgggaaacccaggggccggtggaattgggattttgttgcgttataagcaacatgaaaaaaaactgtatcaaggcttttttcaaactacgaataatcgtatggagttaagagcggtgattgttgctctaaatagcctaaaagaaccctgttcagtgattttgtatagtgatagtcagtatatgaaaaatgggattacaaagtggattttcaattggaaaaaaaataattggaaaaccagttcaggtaatgcggtgaaaaatcaagatttgtggtgttcattggatcaagctattcaaaaacatcaaatagaatggcgttgggtcaaaggacataatggacatcgagaaaatgaaatttgtgatcagcttgctaaacaaggtgcggaaaacccaacgctggaagacgttgggtatcgagctgaatagaacaggctaaataaaactggcgagaaagcgtagtcgaaataaatgatttgactccaaaatattcgcctttatttttcaggtaatttcgcaatgactgcgtaaccttctttcaaaccttcaatttgataggtaacatcggcacaaataaatgcactctctccctgttttaattcaagtgcggtgtgatttgcggttatttttaatgcaccttgcatgacgagtaaaatctctgcgttacttgaggttagggtgtgtttttgttgcacgctataacgtacgtttgtcatggcaaaatctttagcgggcgtagtgtaagtaaagatgtcttgatcttgaggtgccttaggaataatttgaggcgtaatttcactgcaatcaactatttttaatagctcaccaatatccacatgttttggtgttaatccgccacgaataacattatcagatcctgccattaactcaatattttgacctcgtaaataggcatgcggaatgcctgcatcttgataaattccctcacctatattgagatgaacaatattaaataaatagaaacaaattaatccagcatccagtttatcagccggtatttccattgcttcaattgtatataaaacccaatagtcgggattatttaatttcagttttccctgtctataagcaacctgattttcagtaataataggggatagccacgcagaaagttgagtttgatcagcttgcataattgttgcataaaaactgtgtaagtcttgattttccagctgttgggcaagtgcggtcaaagatggacgggcttttaaggtttcaagaatgtttgttttttgtttgaaaccatgcaacagccaaaaatcagacaatgcaatcatcatttcgggtttatggtttcgatctttataagttcttttcggatcttttaaatctatggctgcaagattctcttgtgcaaaacctatttccgcttgtttttttgttgggtgaagttgaattgaaagcggctttgcaacatctaaaattttgagtaaataaggtaattcctgtccaaaatttgctaggcttgctttccctaaaacttgtgggttttgcaccaaaaaatctgttaatggcactgattttcccgaaatatttaatagagaaggggcggaagaatgtgctccaagccaccattctgcataatattggttgtgctgtttttctacgtttaacaactcgggaaggtaattttgtccgccccaaacatagtgttgtaaatgcccttgtagttgataaatggtattcattttgctgtccttttatttgataattatttataaccgccaaaaaattgcactattttttctatatcttgcgtgttttccggtgaaatcataagacgttttttattttttaagtcaatcatcaggattttattttcaagcagattaatttgttgaattttagcataatcaatataaatattttcaaagaagaagccttgttctttcagtaataaaacaggaaagcgaataaaggcaatataaagactgagaagaatggtcattgctaataaatagagggttgttgtattaatttgtcctgaactttgatagagaatgatggcaacgagtacaataaaaatgagtgcatctatttttgctcgctttttcaaccgcactttcaatttcgttgttcctttaagatagtccatcataaattgatcgtaaaaggcataaagaaagaagcaacaaatacccacaataagaaaggcattaaccatatattacattcctaaaatgaaaaacttctcccgtgcagggagaagttttcggataaattaagctaagatacctgttgcggcacctaaaataccgataataaagataccggtaataatccataatgcgttaatacggttgcgtaataaccacatacaggcaaaagtgaacaataacggtaataatcccggcatcaaactatcaagaatattttgtacagttgttgtttcaattgtgccgtcttgtttttcaataacggatacgactaatggtacattaatactggtccatttctgcactaaagcccccataatgaacaaaccaagaatcgaggcaccttccgtaagtttttgcaacaatccgccactcatatcctgaacaacgtccaagccttttttatagccataagtaacaccatagtaacgtgttgctaaacgaactaaattgaatagcacgaagaataaaataggacctaaaatacttccattgatcgctaaacctgcacccaaagcagcaaatacaggtcttgcagtaccccaataaattggatcaccgacccctgccaaaggtcccattaagcctactttgataccgttgattgctgcatcatcaatttctttaccgttcgcacgttcttcttccatcgcaatagtaacgcccaataccggtgcagcaacgaaaggttgcgtattaaagaattctaaatgacgtttaatcgcatctttacgttcttgcgaatttggatccggatataaacgtttgatcacaggaaccatagaataggcaaagcctaatgactgcatacgttcgaagttccatgaaccttggaaaatgtttgaacgaagaacaacggcatttaaatcactttgggttacttttttcatttctgttgtcattttttggattcccattaatctaatctgttatctaaatcattattgttatttgctacaacttgtaccactttactttgattgtatttcgggtgaagctgaatataaagtgcggccatgattgcaccaagtacaccaagagcaacaaggttgaaatcggtaaatgctgcaataacaaaaccagcatagaagaatggcattaaatgacctgcacgcatcatattgatcaccatggcataaccgacaaccgcaataataccaccggcaatttttagaccgtttgttacgactgctggaatagcgtttaacatatcttgtacaacatcggttccagctgtcaacgcaacgacaagtgcagggattgcaatacgcattgcttgtaataatagtgcactacgatgaatccaatctaagcgggttaagttaccgtcttcaattgatttatcagcagcatgttggaagccgacagttaaagcacgaacaacataggttaatacttgacctgctgcggctaatggaattgcaattgcgataccggtgctaatatcttgtccaccgacaataactaagattgttgaaacaacggaggctaaagcggcatccggtgcaagagccgcaccgatattcatccaacctaacgccaagagttcaagtgaaccgcccacgataatccctgtttttatatcacctaagactaaaccgattaatgtacaagcgattagtggacgatgtgtttgaaattcatcaagaattgatcccataccggagatacaggcaacaataaagacaagtacgacttgtaaagttgaaatttccatttatgtcttccttaaattaaattattttttttgagtaaatccatcatatattgacgactgtcgttagatactttacgaacatccaattcaatgcccatcgcatcaatggctttgaatgcggcaatatctttatcatcaacagccaccgcactcgtaatcatttttttaccgtctttatatgccataccaccgacattaattgatttcatatcaacaccggcttctaacaatcttaaaacatcggtaggattagtgaataatagcatcatacgttcatttgcatattcaggattgttgtatacacggatcattttttctatattcacaacatgtgcggtaactcctggaggtgcaacgcttttcagcatggttgagcgaacttgatctttggcaacatcatcattgactacaacaatacgtgttactcgactttcttttgtccagcgagtggcgacttgtccatggattaaacggtcatcaatgcgagctaaacctacaatgagattgccttcttgttgtttgactgcgatttgaggttgttcagggacaggctgtgaaagtgcggtagtttcagccgatttttcttcatattttaaagcacgaacaccagcacggccggtttctaacgcaatgctcactaattcttgtaagctagggttatcgtcacgtgccataaaagtttccactaacataggcacatttacaccggttacaatatccatattagtgttatcaccaattacacgatttgccgcattaaacggactgccgccccaagtatccactaaaaacaggacttcatcgcaatgtgctaatgttgtacttaatttttcttgatacttcgtcataatcgtttcagcattttcgcctgaaacaaaatcaatagttgcaacattctcttgctcaccaatcaacatttctgttgttttaagcaattgttcagccgcaacaccatgcgttgctatgataatcgcaatggacattcggactccttcctaaaagtattaaattgatttaaagggcaggtattataaaggaagttttattttaataatgtgatacagatcacattttaagatgttttttgggtttaaagtgtgatgtaaatcacgctgattgcaaaaaaaagtcaaataaatgtgatttagttcactctttactcgacttattcaaaaatgcacaaacaatcaatttaacgtactttagcaagattgtttttttgagtttttaataattcagcatgtgctttcttttgctcttttattttattgttaatttctctacgctgtttagacagttccgcattacgaattgtataatcgtcaacccgagtttcgtaatcatcacgcatactttcaataatcgcacgcacatcagcaatactcatatcattacggatatattgattcaggttatccaatagcaacacacgcttttgattatcacgaattttacgattattgtcgtctatgtcgcgtaaaagtttgttttttaaccgatacatacgtacatactctaaaacttcttggaaagattgtttattgatattttccatttttttcttctcttttattaaatgaaacttcggctaatttaactttttttcccttattcgtcaaagtgttctctaggaattttcttgagctgtaaaaaattcagaaatttattaaaagttagttgattaagctgtgacgagatgatagaaattaaaaattctttttataaaaccaattaggataaaaatatgatgcaagtatttaattttagtgcaggacctgcaatgattccaaaagttgttttggaacaggcacaacaagaattgttgaattggctggatcagggtacttctgtgatggaagtcagccatcgtggtaaatattttatggaaatgattacacaagctgaaaaagattttcgtcaattgtataacattccggaaaattacaaagttttatttttacaaggtggggcaagagggcaatttgctgctattcctatgaatttagccaataaaaaaggcaaaacactttatcttactagcggacattggtcggcaactgcggctaaagaagctcgtttgtttacagaggttgatgaaattaatattttacttgatgggaaattagaagtaggggaacttgattttagccacattgcttcacaatatgattatgttcattattgtccgaatgaaaccattagtggcgttgagattgttgacgtaccaaatgtaggtgaggcggtattgattgctgatatgtcttctaatattctatcccgtgaaattgatatgagtaaattcggcgtcatttatgccggtgcacagaaaaatctcggtccggcaggtatcactattgtgattgtgcgtgaggacttaattggtcaggcaagaaaagaaacaccgtcaatttggaattatgaagtccaaagcaaaaatagttctatgattaatacgccgccgacttttgcttggtatctttgttctcttgtattcaagcatttgcttgcactgggtggtgtcaaagaaatggaaaaacgtaatcaggaaaaagcaaaattattatatgattttcttgatcagagtgatttttatcataatgttgttgcacctaaaaatcgctcattaatgaacgtaacatttaccacaaataatgatgaacttaatgcgaaatttgttgcagaagcgacagcttgtggattgcaagctttaaaaggtcataaggtattaggtggaatgcgagcttcaatttataacgcaatgccgattgaaggcattaaagcattaattgaatttatgcgtaaatttgaagcagaaaataactagaattttatagcaaaaacgaccgcactttaacggttattaatttcaaataaggatttttatgcaatacatcaacatcgccaacgaaggcgtaaaatccctgtctccttaccaggcgggaaaacctattgaagaattagaacgtgaattagggattagcaatattgttaagcttgcctcaaatgaaaatcctttcggttttcctgagagtgctaaacaagctatccaaaggcagttaaatgatctcacacgctatccggattccaatgggtttgaacttaagcaagtgatttcgaaaaagttcggtttgcaaccagaacaaattactttaggtaacggttcaaatgatttattggaattaattgcccatacttttgcttcggaaacagacgaaattatttattcgcaatatgcttttattgtctatcctttggtgacaaaagcgattaatgctgttgcacgagaaattccggcaaaaaattggggacatgatttagacgcttttttacaggcgattaatcataaaacaaagttaatttatatcgctaaccctaataatccgacaggcaattttttgactgaacatgaaatagatcatttccttgctcaagtacctgaaaaagtgcttgttgtgctggacgaagcctatacagaatttacagatgaaaaagagcggttaaattcttttaaacttttacaaaaatatccaaatttaattgtttctcgttcattatccaaggcgtatgggttagcaggcttgcgtatcggttatgcggtatcgaaccctgaaattgcggatttacttaatcgtgtacgtcagccttttaattgcaatgttcttgctttagtttcagcggtagccgtgatgcaagatgatgcttttgttgaaaaagtggctgaaaataatcgtattgaaatggttcgttacgaaaatttttgccgacaacaaaagttagattatattccatctaaaggtaactttattactattgattttaaacgtccggcaaatgaaatttatcaagcattgctacataaaggggttattgttcgccctattgccggttacggtatgccgaatcatcttcgcgtcagtatcgggttaccgaaagaaaacgataagttttttgatgcattagtaaaagtgttaggcgaggtctttgttgggtgaagaaaagtaatttatacttttgcaatatccctatttacaacttaagaaagcaacataattttatggaaaaattaacgttatctccaattagtcgcattgacggcgaaattaatttaccaggttcaaagagcttatctaatcgagctctgttattagccgcacttgcaaaaggaacgacacaggtaacaaatttattggatagcgatgatattcgatatatgttgaatgccctgaaagcattgggtgtgaattaccaattatctgatgataaaacggtttgtgttgttgaaggtattggcggtgcatttcaatggcaaaatggattatctttatttttaggaaatgcagggacggcaatgcgtcctttagcagcggcactttgtctaaaaggtgatacggagtctgaggttattttaaccggtgagcctcgaatgaaagagcgtccaattaaacatttagtcgatgcgttgcggcaaaccggagcaaatattcaatatttggaaaatgaaggttatccgcctcttgctattcgtaatcaaggtgttttcggcggtaaagtacagattgatggatctatttcttcgcaatttctgaccgcacttttgatggctgcccctctcggtgagggtgatatggaaattgaaattttgggggaattggtttcgaagccttatattgatattacgctggcaatgatgaaagatttcggaatcaatgttgagcattataattatcagcgttttttgattaaaggtaagcaatattatatttctccgcagacttatttggttgagggggatgcttcttccgcttcttattttttggcggcagcggcaattaaagggaaggttaaagtaacgggaattggcagaaattccattcaaggtgatcgtttatttgcagatgttttggctcaaatgggggcaaaagtaacttggggagaggattttattcaagttgaaaaatcagagctaaaagggattgatatggatatgaatcacattccggatgcggcgatgactattgcaatcaccgcactttttgctcaaggtgaaacggttattcgtaatatttacaattggcgtgtaaaagaaacagatcgactaacggcgattgcaactgaattgcgtaaagtcggtgctgaggttgaagagggggaagattttatccgtattcagcctcttgcattggataaatttaaacatgttgaaattgttacttataacgaccatcggattgcgatgtgtttttcgctcattgcattatcagatacatcggtaactattttagatcctgcatgtactgcaaagacttttcctacctatttttccgagtttgagaaaatcagcaaaaatcaatagattaatgggcaatttattgcccgtttttttataattaaattctatattcaatttgtgtaataagtaaaaagtcattaaaatgggcgagtgtttattcgattcttgtaatattttattcgattatcgaaaaaaatccgctttgtgtaattactacgccggaggctgtaattcagtatggtgatgaacattttttaatgttaaagattttatttttttccgttaggagttagtcctcatgagtattcaaactcacataaaagcaaaacgttctcatgtgtttttcttaaaactgtttttgggcatcattgtgcttttatttgccgttatgatcggtttaaaagttgcttcaaaaatgcttattggcaagatgatagccggtatgcccgaaaaaacgacaccggttacggcaattacagttgtaccaactacctggacacctgttatcgaaacaacaggcttggtgagacctaatcaaggtgcggttttgagtgcacaagcaccagggactgttgcaaatatatttatccaatcaggacaacctgttaaaaagggagatgtgttggttgagttggatatttctgttgaacaagctaatttacaggcatcagaagcaaaattaaccacagcaaaacaaatctataaacgctatctgaatttgtataaaacgaagagtgtttctcagcaagaattggataatgcaaaagccaattatgagtcgttggtagcaaatattaacgccttaaaagcagcaattgagcgtcgcaaaattgttgcaccttttgacggtattacaggtattgttaaagtgaatgttgggcaatatgttaatgtgggaacgcctattgtacgtgttgaagatacaagttccatgaaagttgatttttctattgcacaaaatgagttggaaaagttgtttattggacaaaaagtgacggcaacaagtgatgcacgtttaggtgaaacgtttggtgcaaaaattaccgcacttgaaccagcagtgaatgcagcaaccggtttaattgatgtgcaagcaactttcgaagatgaagacagtcgtaagttactatccggtatgtttatgagattgcgtgttgcattgacgaccgaaaaagatcaaattgttattccgcaagtaggtattagctacaatatgtatggtgaaagtgcttatgttttgaccgcactttctgaggaagacaagaaaacattacttgataacgaaaaatttgcttataaagacagtatagacagggtttatcgagtaaaacaaactactgtatttactaaagatcgtcagggtatttatgcacaattaaaagggcaagatattaagccgggtgaccaaattgtggttggcggtcagcaagctattaccaatggtagtttagtggtggttgttgataaagaaacaataggcacacaacaacctgccaagaaaactaatctttaattttaggtaggaatatatccaatgaaatttaccgatatatttattcgtcgtcccgtattagctgtgtcaatcagtttgcttatcattattttagggttgcaagcaatttcaaaattgagtgtacgtgaatatccgaaaatgacgacaacggtaattactgtagcaacggtatatccgggggcagatgctaatttgatgcaggcatttgtaacctctaccttagaagaggctattgcccaagcggataatattgactatatgtcatcaagcagtgcggctaattcttcgataattacagttaaaatgaaactgaatacagatcctaatggtgctttagctgatgtattggcaaaagtgaattctgtgcgttcaagattaccgcataatatagaagatcctgtgatttcatcttcaacaggtggtacaggaattatgtatatcagtttttattctgataaattggattccagtcaagtgacggattatatcgaaagggttgttaagcctcagttatttactattgaaggggtagcgaaagctcaaattttcggggcggctcaatacgcattgcgtatttggttggatcccgaaaaaatggcggcacaaaatctttccgcactggctgtaatgtcagctttatcggctaacaatgtgcaaacagcggctggaagtgcggatggttattataccgtttataaaaataaagtcgggacaaccactaattctgttaaggatttagaaaatttaattgtttattcaaaagacgataatcttgtacgtttgcgtgatattgctactgttgagctaaataaagaaagtgatagtacaagagcaacagcaaacggtgctgattctgtcgttttagctattgaaccgactgcaacagccaatccattaacggtagcggaaaatgttcgtccattgtatgcacaaattaaacagaatttaccaagcagtatgtattctgatttgctttatgatcgtactatcgctatcaatagttctattaatgaagtgatcaaaactattattgaagctactgttattgttttggttgtgatcttactatttattggttctttacgtgcaattttaattcctattattactattccaatttcattaattggcgtaatcatgattttgcaattatttgatttctccattaatttgatgacgctattggcaatgatcttagctattgggttagtggtagatgatgcgattgtggtattggaaaatgtggatcgtcatattaaagccggtgaaacaccgtttcgtgccgcaattattggtactcgtgaaattgcaatacctgttatctctatgacaattgcattgattgcagtgtattcacctatggcactaatgggcggaattacgggatctttatttaaagagtttgctttgacactggcaggtgcggtctttatttcaggcattgtagcattaactttatcgccaatgatgacaagtaagttactaaacaataatgcaaaacccaatcgtttggaacagcaaattgaaaaatcattaactcggttaaccaatgggtatgtttatgttttaaatttagttatggctaaccgtaagtgtatgcttgcttttgctgctattatttttgccatgttaccatttttgtttacttccctttccagtgaattgacaccagcagaagataaaagagcatttatcgctattggttccgcaccttctaatatgaatgtagattatgctcaggaggcaacgaaacagtatgttgatctgctgaacaaaacagaagaagtacaatttacaatgtctattgccggttttccaggctctagcggtacattaaatgttgtaaccttgaaagattatgaagaaggtggtcgtagtcagtcagagattatagaagagttgaatcgaaaggcaacgcaaattccggaagtgagtgtttctgcctttaattttcctgaaattgatacgggagaatccggagcaccgataggctttgttattagtacagcaaataactatcgtgatttagcaccggttgcagaagcatttttagcgaaaatgcgtgaatcaggcagatttgtttatacgaatctcgacttaaagtttgataccgctgaaatgcaaattagcatagataaagaaaaagccggaagttatggtgtttctatgcaacaaattagtagcactttagggagctatttatccgcagctacggtaagtcgtgttgatatagacgggcgagcctataaggttatagcacaagtcaaaagagcggatcgtttaacaccggaaagtttgaaaaatttctatgtatccgcaagtaacggaaaaagtattccgttgagtagtttaattagcatggaattggtaacacaaccgacatcattgtcaagatttagtcagttaaactcggcattaattcaagcagttccaatgccaggagtttcagtaggtgatgcggttcaatggctgaaagatgcagcgacggagttactgccaaaaggatataactatgattttcgtggcgaagcacgtcagcttgtacaagaagggaatgcgttagtaataactttcgtgttagctgttcttattattttcttagtattggcaattcagtttgaatctattcgggatccattggttattatggtttctgtgcctttggcggtaagtggagcgttactggtacttaacttcttgagcttattaactgatatgagaattttagggttatcaggagttaccctgaatatttactcacaagtaggattaattacactggttggattgattactaaacatggtattttaatgtgtgaagtagcaaaagaagaacaactttatttgggtaaatcacgaattgatgccatcactgaagcggcaagagtgcgtttacgccctattttaatgacaacagcggcaatggttgctggattaattccgctcttgttggcatcgggagccggtgcggcatctcgttttagtattgctatcgtattagttgcagggctttcaataggcactttatttacgttgtttgtattgcccgtaatttattcttatattgccagtgaacacaaacctttacctgagtttgatgaaagtataaaaccattggcgactgatcagcatcattaaattcaagcgataaataaccgcacttttaagtgcggtttattatttcaactattttatttgcaaacgcaattgggttttctaaatgagcattgtgtccggcacgttcaattaaaaataaatttaattgattttcttgtgccattttcttaaatttttcatccttttcaccacagaaataataaataggcagcgaaaaagaccgcactttttgatgaaaagatggttgtttggcaagtgacgttgcgattagcatttttgcaatattttggcctgattgatgtcttcgttgagaaattaattgttttcgctctcgtgcagataggtgagcaaaaacaggttgctgataccaatcatttaaaaccttggacatagtttcttggctaaaacgttttgcccaagccaaatcattctgccagcgttcaaggcgttgttgttcattttctaagcctaaatttgcaccttccaagataagtgcaacaagtttactttgtggatatttagattgcagtgcgtaatttaaggcaagacgtccccccaatgagtaaccaacgagaatataaggcttatcggcaatttttgcggtaatttgtcgggatagatattgtgcactttgttcaaaatcttctatgtgatagtttgtttgttcaccatgaaagggcagatctaaacacagataagattgtgaggaaaagtgcggtagattttttttaagttcttcgataatgtattgccaatcttgttttgttccaagtaatccatgtaaaaaaactaagatcggcatcatacgctatacctcttaaacaccgattaatgcatgaccaattttgtcaataagatctttatagatattactaccatcatttggattgactttaatttcgatgatggtcgtttctctgcgtgagtaggcttgtttaagtaccgtagccagatcagcccaagtataagggcgagcatatttgagatcgaacatagctgcaatatgtgaaaactcaagatagtgcgacatacggtaatatttttctttcactgcgatatcaacaggaagcatatcaaagattgctccaccattgttattaatgacaaagataattgccggttggtttagttgtttgaataatgcaaaagagtttaagtcgtatagcgtggaagtatcgccaatcattgctaccagtgtttgttcggaaccaacagcaattcctgccgcagtcgcaagcaaaccatcaattccacttgctccacgattagtgtaaattggataattagcggaaggttggcttagtgcatcggcaaggcgtacaaataaactgttccccaaaaagagaacgctattagattttggtagtaataattcaatattatgtgccaatgaggcttcatttaaatttgaacctacacgttgtttgataaagtccgcacagaatttagccaatgctaaaggctcaagtaaccaaggttttttccgcattggcggatgggctcgtaaccagtgatgcggtttagcattgaaacgtgtatgagcatgatgatagggatcaacagctttttgattattttcaataatccagtattcacctttaaattctgctaagaattgattaattcgctttccaataaatcctgagccaaattgaatgacgatttcagcttgtaacagtttttttctgacagtttggtttgccagccaaatatctgcataaggtagggttggtttaacatgggattgaatgtctgtaatcattatccaccccatattttctgcccattcagcaattcccattgcctgttcggaaggtaagcgtccaacaataattatgccttttttggttcgccattgatcccaatatttatgtgtaataacttccgtgtgttgttcttgatgttgaatccaatttttgttttgtgttagccaagattgaatattactgagccaaggatgaagatctatttcatcattattggcattatagagcggttcagcaaaagggacattgatatgaataacgcccccttgcttttgtcggaaacaagcctgatctaaaactgaaattagccattgagcagaatagttttgacttggacgaggcagatttatgctggcgatcgggtattgtgcaaacatattttgttgcaaaatagcttgattagcaccgcactcaagcaattcaggaggacgatctgcagttaagataattaatggcacatctgtttggcgtgcttcaataattgcagggtaaagattagctgttgctgtaccggatgtaacgattacagcaaccggttttttgctcgctttagcaattcccaatgcgaaaaatcctaagcctctttcatcgaaatgagtatgacaggtgccacgtccgttttcctgtaaacggatagcttctagtgtaagtggtgtggagcgtgaacccggtgcaatacaaaaatgagaaacaccttgacggctcaaggtttccaaaatcacttttgaccaacaacggttaaaaacgctggctgacatattttctactccgtttctttctgtaatagggatattagccctagtgctttacgttctatttcttgccattctaataaaggaatagaaccttcaacaataccggcaccggcaaatatacgaacataatcttgttcaataaatgagctacgaatagtcacacaaaactcagattctgttttagtcattattcccaatgcccctgcataccaagtgcggtcaaaagtttcggtattttgcaagaacacttttgcttctttttgtggtaaaccggcaatagctgcggttggatgtattgcatttaaacatactgcatcagtatttcctgctttaagtcgggcagaaatttctcgttttaaatgttgaacttggcgtagttgcttaatttccagttcactcaccgtaatttcctcaacatagggtataagatgttgacaaatgccctctacaaccaaactgttttcataaatatttttcggatcttgtaataaccactgagcttgttgctgattaatatgttcatcatttgttataaaagctgtccctgccaatgcttcagtgattaggcgattttctttacgaacatataatctctcaggcgtggagcctataaatgcttgtgtattattttgagcaaacaaaaaatgatagcaacctgtattgtacttctcactttcagctaaaaaatccttagcgtttaatgggctatcagttttaaagtcggtttcatttgccagcacaactttagtcagatttttttgcttaatttcatgcaatgctttttctacccaaagacaccattccgtttgatttgcttttgttgttatcaattgaattgattgatgaattgggtttaattgaacttgtttttccaaagaatgaataatattcaacagatcatatttttcttgttcccaaggttttttattatcaataatgagttgaataacaagtttttgttcttgtatgaatgataaacgtggcaaaataaatagaggttcaccattaaattgacagccgccgataagagataaattaaattgttgcacaaacgtttgtgctgatttaacttgcgtaaagcgacatacttctccaagccctaagatttttttattggtatcacgaaaattaagataaaattgcggataatgacattgagcttttaaccaaccgagtaaattcaattcttcatctaaatccaaacgaagaacggaaaagtcgtttttagggtcaaattggtattgattaattaagcgaataaactcagccttaatctcgtgcaaattatccattttgtatcgtattaagttaaacattcagttgaaaacagctcttaattctaccgcactttaaaaattttttttataaaatcttttcatctttttaaaataagcgtaaagtgtggctatattttgagtgacattattattaaaaggatagtctatgcgagttttccctaaatccgataagttagaacatgtatgctacgatattcgtggaccggtacatcaagaggcgttacgtttggaagaagaaggcaaaaagatcttaaaattaaatattggtaatccagcaccattcggttttgaagctcctgatgagattttggtagatattttgcgtaatttgcctgccgcacaaggatattgtgattcaaaaggtctatattctgcacgtaaagctattgttcaatattatcaatctaagaatattttaagtgcgaccgtaaatgatgtatacatcggtaatggtgtttctgaacttattactatgtcattacaagcattgttgaatgatggtgatgaggtgttaatcccaatgcctgattacccattatggacggcagctgcaacgttagccggcggaaaagcggttcattatttatgtgatgaacaagctgattggtttcctgatgtggcagatataaaaagtaaggttacttctcgcacaaaagccattgttattattaatcctaataatccaacgggagctgtttatagtaaagaattattattagatatagttgaagtagctcgccaaaatggattgatgatttttgccgatgaaatttacgataaaattttatatgacaacgctgttcatcatcatatcgccgcattagcaccggatttgttaacggttactttcaacggcttatcaaaatcttatcgtgtagcaggatttcgccaaggctggatgattttaaatggaccgaaacagcaagcgaaaggctatattgaaggtctggatatgttggcctcgatgcgtttatgtgccaatcatcctatgcaacatgctatacaaacagctttgggtgggtatcaaagtatcaatgaatttattttgccgggtgggcgtttattggaacagcggaacaaggcttatgagttgattaaccaaattccggggttaagttgtacaaagccaatgggagcactttatatgtttccgaaaattgatactaaaaaattcaatatctatgatgatgaaaaaatggtattggatttattgcgtcaagagaaagtgttattagttcatggacgtggttttaactggcaacaaccggatcattttagaattgtaaccttgccttatgtgaatcaaattgaagacgccttaggaagattagccaaatttttaacgcattatcgtcagtagttgtgaaacaagagagaacattttgctctctcttgttttgtcttttaaccttcttcacaaaaattttcaggtaaatttgtcagtattcctttccaaatagcactactacgttcacgattttccacaagataaacactggcttgttgataatctccatttcgacaacattctttcaattgttgatagaaagtgagttcaacttggcgtgattgcggattaataaaaaaaagtgcggcgacttgatgataaagtgttctaaaactgtttaaaatcaaagtatatacgggcttatccgatataaagctaaaacgatgatagaggttatagtcaaattccgcataactcttttcatcatcatctaattcatctaaagattggaaaaattcaaacgtttgttgaggattaatttttattgcttcaggaataaattgttcacccattcgagtacgtaaagataccacatttgcaatgacggtaggtttaagagtagacgataattgaatgagtgtttttaaaatattggggccagctgtttcccaaatattgtttactttggttggtttaccatgttgaatatttagccaaccatcacgattcaaacgctgtaatacttcacgtaatgttgttcttgttacaccgattttgtttgctagttcacgttctgcaggtaaatctgagccggcaggaaaatgattattccaaatgcttttgacaatatattcttcggctaacgcagccggactttgtgctttaagaatatccatacttctctttttgttaaacatactgtaataactaggtgggcattatccttgaaagcgatttatattacaatcatttaattatgttttttgctttcctttataagtgttttattctatattactcgtgcgtttgtatttttgtgttttgagtttttatgaaattaatttgatgacattaaggatcataggcatgctcatcttttttaaaaatttatcaatgaaacgtagtacttggatactgctgttcatttcagcattagtgttagaaagtaccgcactttattttcagcatggtatggggctgaatccttgtgtaatgtgtatttatgaacgtgtagctattttaggtatcctgttttcaggattgattggatttattgctcctagaggcttagttttacgcattttagctttacttattgggttaggtagtgcggtaaaaggattattattagcaatcaaacacttagattatcaacttaacgtatacccttggaatcaatgtgcaatggttcctgattttccccaaaccttaccattggataaatggtttcctaatatatttatgccttcaggttcttgcagtgatattacatggagttttttaggattttctatggtgcaatggattattgttatttttgcatgttatttcctatttttcattattctcagtataagccaatttaaaaaagtcagaaaaaacagaatgctgtttagatagctctgctcgttgaaatttttctcaaagtgcggtgttaaaatacattatttttgtaccgcacttatgttattaaaaaatcattccttaaagcttacttgttcctagcgtgaacgcatctcctttagggggattagacgtagggaaaatcaagatttaataaatcttatagattattttgtgtctaagatctttagcaaaacgctttaacttacgtataaacggtacgttttcaattttccattctttgggtggattttcaagttgctggaataaatgacaaaataaattcgcttttagcattgaacatttttcatgccatgatttttttggaccaacataatgaataatagcaagaggcatagtcgcttcttcatattgattccgttcttttttacttaccctttttagtctatttaacgcattggcagtaaaattatatcttaagtctaaatattttacattattcgcaaaaatagcatttaaaatatcctgatcttgatacaaaaattcaatattattacgtttacaatattcaatccattgtaatgatttttcaaaaacatgacatttttcccattcaactacattaattaataatacaccggcattaaaataaaaatgtgtattaggtagatgaagttttgttttataatctgactgactgactgactgactgactgactgactgactgactgactgactgactgactgactgactgactgactgctcattcttttgcttttttcttgggattcaataaaagcatcataacaagctccgattgccttgtttcctaaatcagtattccacaacggcaacagactatgattgaccaatatgtcaatatccaaataaataattttcgttaaattaaatttttttaaataacttgctagatttaacctggcgtaggttgataaagaaatatattctattgttctaggaaatttttcaaaatcacttatattaataggggtaatatccaaacgacagttgtttttattggctagttcaatgcaataatcctttgcaacagtagaaatacccatatccaacaaataaaaatgaatagtataacactcattgtttttatctctagcgtgaataatacttaacatagttactgctaaatattttgcataattgtcatcacatgaaaagagaatgttcatttgtttcttcttcttattaaggattttaatgttttactcagtatttttcttttttgtaataaatttaaatgtttatattttaaaatatataagagaaattcaatagagccacaattttgataaattaaatttagtatcatattgaaaagaacaacattaagcgatttaaaatcacttgctggtaaaatattttttttagatgaaataaattcggcaaaatcagataaatcattaaaacaatagttttcttggaaagagtagttaatgcctaatttttgtaagagaaagttggttgcttctattcttattcttctagctgatttttcttgtatatcactatattttgaagatatttgattatggtgtaccctatagtaagtaaatgattgagggatatttgccatttttcctcttttaagtatttctagccataatttataatcctctgcatgcggatatttttcatcataaaagagattatatttcttaaaaacatcgtttcggattaccatagtgggatgagtaaattgatttttaaatggaaattctcttaaaatttcttcatattctaaacagcctttccacacatctttatttttagtatattttcccacttttccaagtggaacatcattatcatgcaatatagtaataaatccgccaacagcaagcaaatccggttctctttccattttttctacaatcgtttcaatccaaaagggttcaacaatatcatcagcatcagttcttgcgacatattttccattacaatatgttaaacctttattaagagatttaataagtcctaaattagtttcattttgtaatactaataattcccccccctagcgtattcatgtgataatctatttaaaatttcctgagtattatcagtagatccatcatttactacaattacttcaatattattataagattgaagcataattgcacgaatacattcttctatatatttttctgcattatatgctgaaatgagtacagaaactaagttattcattatttttaacctctctataagaattttacaatacgccaaccattcaattttctttttaatcttcttctaaatcgccctatttccttcgaaatacttcgccataaattccttcttgcttttttattattttywctctctctctctctctctctctctctctctctctctctctctgcacgctctactgaaataacgctggttaacttgcagttgttttgatttaaaacattatcttgaataacaattgcaggagaaatttgataaacgggatattgttcttcttttaataatgattcaaataaaataacatcaattggctcaactgaaaaatcaggagatttaaataaatctaataatttttttgcggcaatttgtgaaataatatatcctgcagttccccattgttgagacattaattgaggaaaacaacgctgttgaaaaaatttaattttagttttgcgatatgctgaattcattaaataagtttctaaacgaagaataaaatactgattcacatcaaaccgctcttttaaccaatcatattgaccaagaaattgatgggcgactggactgagaataatgtcatcttcaaaaatagcgataaaaggtaaattttcatcaatacatttttgccataataacacatggctcataaaacagcctttttctcctattgtcagatcggttttatttaaggaagggacatattgttgaataatatgttcattttcttcattaggttgaaacgcattaaaaaaggaatatggaatattttgttcgccaaaatatttttcaatatgttgacgtctttcaactgaactttttaaactgataacatgattaaacattatatttcctaaaaataaaataacgtattctaacaatgatatgctatgtgcagagatattattataagaattttatacgacgataacctttcaatatccttcttctaaatcgccctatttccttcgatatacttcgccataaattcttttttgcttttttattatttttactctctctctctctctctctctctctctctctctctctctcgggtgcaagagaactggttaatgtgcagttatctttatttaaaatacaatcctgaataataatggcaggctcacattgataaaccggatattgttcatcttttaataattgcttaaaaataatttgatctatttcttcaatgaaaatatccgtatttttaaataacgctaataattttttagctgcaacttgagaaagaatatagcctcccattccaaaatgtccagacattagccgattaaatttacggttttggtagtcgggaatttttgtcttgcaatattctgatttcatataaattgtttctaagcggagaataaaatattgattaaaagcgaaccgctcttttaaccaatcatattcactcaaaaatttattggcgaccgaactgagaaaaatatcatcttcaaaaatggcaataaacggtagattttcatccacacatttttgccataataaaacatgactcataaaacagctctttagtttatttgcgagactgcttttacttaaagctgggacatagtgttgaaggatattttcattttcttcattaagttgaaaagcatcaaaaaaagtatagggaatatgttgttggctaaattctttttcgatatgttgacgtcggtcgaccgcactttttagactaataacataattaaacatagtttactcattttttatatataaaatgtagtggtttgctactcaattaaattgacagtataaaaaataatttctaaaatagccaatattttgttgaatttactgtgaattatgttagataatgccaatcaatcaatcaatcaatcaatcaatcaatcaatcaatcaatcaatcaatcaatcaatcaatcaatcaatcaatcaatcaatcaatcaatcaatcaatcaatcaatcaatcaatcaatcaatcaatcaatcagcgatttttgtcataaatttagaaaaagcaactgaaagaaaacattttatttcccaccaatttaccgcacttcaagaacagcatcctgatatcgtaataaattatcagttttttacaggggtaaatggaaacacccaaccaaatcatcctttatttgctaaatacaatcaaaagaaacgctatcagcgaaaggggaatgaaataactttagggcaattaggttgctatgcaagtcattatttactatgggaaaaatgcgttcaattacaacaacctattatcgtattggaagatgatgctattttgcaacccaattttttagctgtttatcagttctgcttttctgcggaaaatcaatttgaatttttttggttaacgcactctaatagttcaaaaattagaacaaaattaattcacacgttacccgatagtacaaaattagaacaacattatttcggttatagtaacacgacaggttattatcttactcctcaagcagcacagaagtttttagagcattctcaagagtggatctacaatgtagatatttttatggatcgtttttatgaaaatcatgttgctttattgggcgtgaatccgccttgtgtcaaacccgatttttctaagcaaagccagattacgatgaataaaaacaaccgcactttttgggttaagttaagacgtgaatattttgcacttcttgagcgtatcaagcgttttgtttattggatgttttattgttgatgatagatatggataaagtgctaggtttacgagcagacaaaactggaaacaaaataggcagggaaattattagaatttccagttcaaattgatctgacagtcagctgttaaacagagactgtcagattagttgctttttattcttgtttgtttagtaaaaatacgccattttcagtgaaatgaacgtaggcctcgtgcgtttcttgtgaaaaattctctggattagcattgatcagtaaatctttaccgccccaattagctatgatttcccaataacttcccatatagaccgcactttttatgatgcaatgttgttgagcaagaccttctgattttagtttgactgcctcaggacgaatacccactaaacattctccatcgttcaaagcgaatttatccgcatcaggtaaaacaaattgatagtcgttaatggtaattttgccttgttctaaatagccattaaaaatactactttctcccataaaacttgctaggaatagagagttaggatatttgtaaagctcttttgccggtgctttttgcatgattttacctttattcatcacgatgacttcatcagataccgcaaaagcttctgtttgatcatgagttacatataaagaagtaatatttaaacgctgttgtaattcacgaattttttcacgcattgcacggcgtaaattcgcatctaaattacttagaggttcatcaaataataacactttcggctttaatactaatgctcttgccagtgctactcgttgttgttgtccacctgaaatttgatcgacatagcgatcttcaaatcctgccaagtcaactaattctagtgcctcttttactctttgtttgcgttcatcagaacccacaccttgcatttttaagccatagccaacgttatcgccgatggacatatgcggaaacagtgcataagactggaatacgatacaaatatcacgattttggatggaagattttgttacatcttcaccatcaataaaaatttctccctcggttggactttcaagtccggcgactaaacgcaataccgttgttttaccacaacctgacggtcctaataaagttaccattgaaccacgttttatgctcaagtttaaattatctattactacagatttaccaaacgatttggtgatatttttgagtactaaaaaatcattattcatatttatagcctttcgttaaaattttttatttttctaccgcacttcgctattcaagtgcggtaccgattaattcatttttttcgcttttgaacgggaaatgcgagtgtcaccaacgatccagtcgaagaataaaataattgccatcatcacaacaattaaaattgaaccataagcaatggctatgccatattcgccatcttcaactcgattcaaaatataggcagtagctactcgtgtatccgctgtaactaaaaaaacaatcgcactgacggttgtcattgctctaacaaagctggtaaccaatgcggaaagcaatgccggttttaataatggaaaaacaataaataaaatagtttttaatgaactgccttttaaagaaagtgaagcttcatctagagatttatctaattgcccaagtcctgcaactgccgctcgcataccaacgggcatgttacgcattaccattgaaagaataataattagccccgtacctgtaaggtaaatcggtgcatcattgaatgcaatgatataagaaacaccggcaacggtacctggtacagcaaagcaaagtaaggttaagaattctaaggtttttttgcctttaaaatctcgtcttactgtaatatatgcgatgagcaatccgaaaatagccgtaattggagccgcacttatcgcaaaaataaccgtttgaattaatgacggccaagcaccatcactgaaaccttgaccaaataacgttatgtaattttgtagagtgaaagtgtaatcaactccccagtttttagtaaagctgccgtagaaaatactgccatataagaccgcattaaagaggatccaaaaacctaacgtaaagacaacgatatattttaaggtcgttggtaattcttgtacgtctcctcgataggattttcccgatactgttacataagaacgattacctatccaccaatattgaataataaatattgcaagagaaaatatgagtaatatcgtacctaacgtgctggctgaagcataatccaattgagaacccgcaatgtaaaaataaatttgtgatgaaatcacatcaaagctaccgccaagtactaacggagtactaaaatccgctaatgattgaatcgctacaactaagaatgaatttgctaaagccggttttaataatggaaaaatgatgctaaaaaaagtttgatagcgatttgcccttaaagtataagaggcttcttcaattgaagggtgaattgattttaatgcaccttctaaaatcatgaatgacatgggagtaagtgctaaagtatgagcaattacaatacctgtaaaaccatatagccagttactgctaaacccaaaatactcaactaaaaatgaagttacataaccggaacgaccaagcattaatgttaccccaagaccgactacaaaaggtggggtaacaataggtaaaatagagaatattttgcctattaccgctgttcgcttagcaactctggtagtataaagtgcgaaaattaacccaaataatgtcgctagagttccaattgtaaatgcaaccgctaatgagtttccaatgatgcgtaaaacatagggtttactcacaatgtccaacacttggctaggtacaaatgtcgagccatcgtagaacatagaaaggaaaatggcgaaagttggataaacaataaagaaaaatataagtaaaatgatacttattagagaaaatataatgaacttatctccttgcataaatttcatttttgccaatgcgttggttgctaatgcaaccaacgtaataaccaagataaaaatggaatatccaagactgaacttttgcaaaatagcagacaaaaatacaaaaaagaagattcctacaacagcaaaaaattcaacttttccttgtttttgttccccgctatgttgaaataaatgagaaagtattggcacaatgagtaatgaaccaaaccaaagccaacttaaattaaacttagtccatcccattgcgtcataaatttcttcagatgtagaatctgttataccatagtgtaatgtcatagttggtaacacaaaaaatccaataaacgacaataaaatccatcctaggctacctttgaatattcgtgtctgttcactcataaaacctccgtgaaacaaaaattactttgctaatttaacttctgtaacccatttatcaataatcttgctgcgaacttcatttgatccaaatcgatcaaaatcataatcgattaagtttaattccgttggcttaagtgaataaggcgatggttcagcattagcattagttggaatatgatgagattgtgccttttgccaagaaagttcttgagcttcttttgacattacccagtcagcaaataattttgcatttttcaaattacgtgcatttttaatgatactgattccgcccagttcatagcccgttccttcacaaggaacaacaagctcaataggtgctccatttgctttttcaaaagagtaattttgtaaaaagcctacacctattgctgtttctcctcttgctgtatttcttgacggagctgtacctgctttaggatattgggatacatttcgatgaagttttttcaagtaattaaacgctgcatcttctccccataattggataaatgttgcaattgccgtgtaagcagtacctgagctttgaggatcagctaattgaatttcgttttttagccgtggatctaagagatctttccaacattttggaatttcagtaatacctaatttttttaacctttcggtatttacaccaaagcctaatactcccatgtatacaacagaactctttccatttcctaatttttgaaattgaggaagcacttctgccaatttcggtgatgtgtaaggttcaatcagacctagttccaccgcttgtaagtgcgtgtcgaatggaccgccaaaccacacatcggcttgaggattatttttctctgctaacatttttgctaaagtgctacctgaactattgcgaataaatgatgcagtaacattgtatttttcagaaaaaccttgaacagctttttcgcagactatattttgagcactacaataaaccactactctccctgccgattttgccaaggtttgagcgtgaaataaacttgcaaaaaataaagcggaaagagataaagcaaattttgataacttcatacttattctcctaagtaaaaaatatttttatttagccaatttaacttcattaatccattttgtaattaaacgtttacgttctacaacgtcaccatatttttcaaaatcataattaataagttgtaatttcttaggatcaaaagctaccggtgattgttctgctgtcgtgttagttaatgtttggaatgattttccttttttccaagctaattcttgcccttcttttgataacgcccaatctacaaacaatttagcattttctaagtttcttgcacctttaataatactgacacctcctaattcataccctgttccttcacaaggtacaatcatttctattggtgcaccttgttgtttttgcaatgcataatcatgtaagaaacctattcccacagctgtttcaccacgagcggtattattagagggggtaattcccgattttgtgtactgtgaaatatttgggtgtagctgtttaaaataatcaaaagctttatcttctccccaaatttgaataaaagttgcaatcgctgtataagcagtccctgaactttgtgggtcagcaatttgaatttctcctttcagacgaggatctgttaagtctttccagcattttggaatttcagtaatacctaactttttcaatcgttccgtgttcacaccaaaacctaaaattcccatatagatagcagaggtataattacctttcactttagccggatcttggaaacgttctacaatatgattaatatgcactgaacgatatggcgttaataatcccatttcagctgcttgtgcttgaggatcaaacgtacctccataccatacatcggcttgaggattatttttttcagcttcaatttttgctaaagtactgcccgaaccattgcgaatgaaagaggtttttacattatatttctcgccaaaagctttggtttcagcttcacacatctcattggtggcactgcagtagacaactaaacgcccctttgcattaacttgagtcgttaccattaatcctgttgcaaaaagtgcggttgatattgcccaagatatttttttcattttcatatggttctccttgtttgaaaaatacctgttgtaagacagtgtaggaatgataacacaagaaaaaataggatcatgtgaggaaagtcacacaatacaaaataaaagggagtgatacataaatcttctgagaatgactgtcaatacaggtaaattttctttataatcggcataaattttcatttaaagtaggtggaatattatccatgtcagatcagtcttgtattattattgccattgctggtgcgtcagcatcggggaaaagtttaattgcatcgactattcatgaggaactgtgtaatgaattaggctgtgaggaaattgggattgtgacggaagacagttattacaaagaccaaacgcatctttcttttgaggaacgtattaaaacaaattatgatcatccaaattcaatggatcgtgatttactaattcaacatttatgcgatctaaaaaagggtaaagtcgttgatattccagtttatagctatgttgaacatacaagaacccaagaagtaactcggtttgagcctaaaaaagtaattattttggaggggatcttgttattaacagatgagcgtattcgtcaggaagtaaatatgtcggtttttgttgatacacctttggatatttgctttattcgccgtttacaacgtgatatggaagaacgtggtcgctcattacagtctgtcattgatcaatataaatccacggttcgtccaatgttcttacaatttattgagccatcaaaacaatatgctgatatagttgttcctcgtggtggcaagaatcgagttgcaattaatatgttaaaagtgcaaattcaacatttgttaaataacaaataaggaacaaatatgagattatgtgatacagatattgagcgatatttggatcaaggtattatttctttaacacctagaccgagcaacgaaaagattaatggtgcaactattgatgttcgtttgggaaattcttttcgtgtttttcgtgaacatactgcacctttcattgatttaagcggtcctaaagaagaggtgaccgctcaacttgatgcggtaatgagtgatgaaattattattggagagcatgaagctttctttttacatccgggtgaattagccttagccacaacattagaagcagtcaaattacctgccaatattattggttggttagatgggcgatcttcgttggctcgtttagggttaatggttcatgttaccgcacatcgtatcgatccgggttgggagggaaaaattgtcttagagttttttaattctggaaaattgcctctagcgttacgtcccaacatggtgattggtgcattaagttttgaagtattaagtggtactgctgcgagaccttacacaagtcgcaaagacgcaaaatataaacatcagcaaagtgcggttgccagtcgtattagtgaggacaagtaagggtatatctgattatgtggaaaaaaatcttcttttttattaccgctctttttgtcggcatagcaattttcacgtatgtgcagattgaaaaaattcaatcaacgttagtcgcaagattaaatgctaaccaaatagcggttgacaacattactattgattttttccctacaaagataacgcttactaatatccaatattctaaacatccttctcacattaatattgacacggcaaatattgaaataagcgtattgaatttattagcgggtaatcttgctgtaaataatattgttctaaacaaaatttcccactcatatccatctttcccagctgttcagcacttaacaatgatagggaaaattacacaacaaaatagcaacattttctttgataatgtgcagctggaactgcaatttactcaacctgtttatttggataaaagaacatttaattttcatattattgaaggattttttaatcaaaatgagatggagactcctaaatttgaaggaaatatcgtcataaatcagcagcctgtgctcattaaagcggagatctatcaatcaaaaaacgaggaaaagggactaaagattttgtttaaagctagggattgtgagcaatgtgcggcagagtttgaatataattcaactcgtgatctttcatcggtgtttacagaaggaactttgcagtttagcagtcataattttcccattgaatattggcttaaaatggcagatttagagccagttataacaggaaaagctgatattgttgcgagtggtgtagtaaaaaataatcggttacaaaaactggacatgccaattacggttaaacaaggatctctatccggcgttaatttgttggagttggcgagcgggattttacctatcaattacgatagagaaaatgcaccgagggatatggcttttgaacatcttcaactcaacgcaaattgggagaataacttattgtatttagaagatatatttattttgactgagaatattattattgaaggcaagggaatttccgctcttgatcagatgcaatgtgatattaatttagttatgcgaccgaccaataaaaaatatcaaaatgtcagtttaactgtacatttctttgatcagtgcaatcgccctcagtatcaattgaaaatccgagcaaaagattatttaaagcaattactaaaaagaaaattttcccattaagtctcatgttaatcatgcagtcttgtactgtgctgaaaaaataaattcaattttaaaataaagtgatatttactatacactttctttcttacctttataaaattattgccaataaacatcattgcaagataaaaatctaaaaataattaaaaattggaattaaataaatatttaattatatttaaaagcaaaaattcaaattaaaatgctaaaaatgacattgacttaaccataaaatttcctcattattgggtaagtaatttacgaggaaaaaattatgtttttattaaaaaagttcagtcatcttttagcaaaatacaccgcacttgttatcattacattagcttgtgttactttttattccccaaatctttttacttgggtaaaaggtgatgcacaaattattgtacttggtctaataatgctatcaatgggcatgaccttaggtaaagaagactaccgtattcttgcaaaacgtccttttgatattttagtaggaactatcgcccagtatagtattatgccttttgttgcaatttctattgcacaactctttaatttgtctctagggttaactttgggtttagtgttggttggttgttgtcccggtggtgttgcttcaaatatcatgagctttctttgtaaaggcgatgtggcttactctgtgggtatgactactgtttctactattttagctccaataatgaccccacttttattgaattatttagtaggtgaaacggttgcaatggacggttgggcaatgtttaagtttatgttgttagtaacattggttcctgttggtattggctcaattatgaacataacgtttgaaaataaaaaatggtttcaagagttgcgtgaattaatgccgggtgttgcggttattaactttgcttttattgttggtggcgttgttgcggtacatggaaataaatttttagaatccggttttataatttttgtatgtattgttttccataatgttattggatacatcttaggtttctttacagggcgtttatttggaatgagtacagctaaaaaacgcactttatctattgaagtaggagtacaaaatgctggtttggcaacaggattaagttcaaaatttttcccaactaatgcggagtctgctattgcttgtgcagtatcttgcgtatggcattctatttcaggcacaattttagcaaatttatttttatggtgggataaacgcaaaaatacatcaactcaaaagaacaatcctgctaaaaatttaatgaatagcacgaaataaaataataaaaatttataccgcacttgagtttgtaagctaatcaaggtaatgtatgcgagtttattttattattgttttatgaggttaatatgaaaatcattcttttgggggcacctggtgcaggcaaaggtactcaagcacaatttattacaaataagtttggcattcctcaaatttctaccggtgatatgctacgtgctgcaattaaagctggaagtgaattgggacaaaaggctaaaatcttaatggatatgggacaattggtacctgatgatttgattatttctttggtgaaagaacgtgtagcacaagaagattgcgagaaaggttttttacttgacggtttcccacgtacaattccacaagcagacgctttaaaatccgttggtatcagtattgattatgtattggaatttgatgtgccggatgaagttattgttgagcgtatgagtggtcgtcgtgttcaccctgcttctggacggacttatcacattgtttacaacccgccaaaagtggaagataaagatgatataaccggtgaagatttaattcttcgtgcagatgataaacctgaaactgttctagatcgtttaaaaatttatcataatactaccaaacttttggttgattattatcaagctgaagctgcacaaggtaacacgaaatactttcgattagatggtacacaaaaagttgaagaagtaagtcaagaattggacaagatcttgagctaagtgcttaaacagttcagacctctatgactacttaatactgagaacatagaggtctgcttttattcattgaatataaatatgctaattattgtgcaactattaccatggcaggtctgataactcgcccatttaatagatagcctttttgtaaaactactgtaatttgattactttcaaacccttctgttggttgcatggaaatagcttggtgtaattcagggttaaaagtttcgccaattacaccgacaggttcaacaccgaagcgtgcaacagttgataaaagtccttttaaagttaactcaacaccatcgactaaacttttgatggtttcattttctacattagcaggagtagacagtgcacgttctagattgtctatcgtttccagcaaatctttagcaaatttctctaaagcaaatttatgtgctttttcaacatcttgttcagcacgacggcgtatattatcaatttcagcacgtgtgcgtaacaaaatatcttgttctttttttacagcttgaataagctgttcctccagttcttgcacacgagcaatagcattttccaacgcatctccatcctgtatttcggtttcttccattggtttttcttgctcattttgagtttcaagttcagctgaaatttcctcttgttcgactttttcttgttctgacattatttttttactccattgttagatttgtatcattgtatcaaaaaacatagaaattaacacccgcacttattggcaagtagagtagaatgtgtgtaatatagtactccttttatttaattcaagtgttctttgtagaaagaccatgacaccagcaaattttattgatagtaaaaaattaattatttcgtttaagacgattgccttagtaggacgccctcgtcatgatgtgaatttacaaatgcacaaaaatttatttcattggctttctgaacgtggttatcaagttttagttgaacgagaaattggtgaacgtttaggattgtcggtaaatcatttagcggatttagatgaaataggctgtttagcccatcttgccattgttattggtggtgatggtaacatgttaggacgggcgagagtcctagctaagtataatattccattaataggtattaatcgtggtaacttagggttcttaactgatattgatccgaaaaatgcttatgctcagttagaggcttgtttggaaagaggcgagttttttgttgaggagcgttttttacttgaagcaagtattgagcggaatggagaagttgttgcacaaagcaatgcaataaatgagacagttatttatccggctaaaattgctcatatgatagattttcatgtatatattaatgataaattcgcattttcgcagcgttcagatgggctgattatttccacaccaacaggttcaactgcgtattctttgtcagcaggaggtccaattttaactccgcagcttaatgctattgccttggtgtcaatgtttccacatacgttatcttctagacctttggttattgatgctgacagtaagatttcggtgcgttttgctgaatataatacatctcaattggaagttggatgtgatagtcaagtagcgctttcttttacccctgatgacattgtacatatcacaaaaagccaagataaattacgcttgttacatctaaaaaattacaattattacaatgtattaagtacaaaattaggttggcttaaaaatttagcttaaaaaatttttataagtctatttactgtatataaaaacatatatataattgtatttatatacagtaaaggattcatgctatgttagttcaacttaccattaataactttgcgattgttcatcatcttgatattgaatttgcgaaaggtatgtcagttattaccggcgaaactggagccggaaaatctattgctattgatgcactcggactttgtttagggcaaagaacagagttatctatgttacgtgacggacaagagagagtggatgtttgtgccacatttcatattgagagcattaatcctgcttatcaatggctacaagagcaggagttacaagattctgacaaccctgaatattgcattttacgtcgaattattaattctgatggacggtcgaaggcttttattaatggcgttgcagtatcagcctcacaactcaaaactattggacaatatttgattcagattaatggtcaacatgcttctcaacaattgctaaaaagtgactaccagattcatattattgatcaattttgtggacatgaggacttattgaaaaatatgcaagaaagttaccgcacttggcgagagttacaggaaaaagtaacgacatttcatcagaaatgtgctgaaaatgaagcaaaaaaacagctattagaatatcaagtagaagagttagatcagtttaatttgaaagaaaatgagtatttggagttggaagaagagcatactcgcttatcaaatagtgaagaattgatgtctttatctcagtcaacattacagttattaagtgaaaatgagagtgtgagtattgatagcctgctttataaagcaacacaatatattgatgagctttgtcaattggattctaattattctgatgtgcaaacaatgttgcaagaggcacttattcaaattcaggaagccacgtctgaaatacaacatttatcctcaaatattgatcaggatccaaaactgttacaggctgttgaacagcgtatgggacaagtgttacaactcgctcgtaagcataatgtgaaaccacaggatttagttgaattacataaacaactgaaaaatgaacttgagcaactcgttcatttttctgaaagtgaatcgcaattgatacaacaagaagaacagatgcgacaacatgtgcaagaaattgcaacgaaacttagcttaagtcgtcagcaaggggcaataaaattatcaacacaagtgacacaatctattaaattacttgctatggaaaatgcggagttctcaattacttttgatgaggataaaaaactcacaagtaaaggttatgatcaactttgctttaatttgagagcaaatctaggtcaatcagtacaacctttaaataaggttgcttccggaggggagctttcacgtattgcattggctatacaggttttaacctctgataaagcagctgttcctactttaatttttgacgaaattgatgtgggaattagtggtgctacagccagtgttgtgggtaaattattgcgacaattgggcgaaaaatgccaagtcatttgtgtaacgcatttacctcaagtagcttgctgtggacataatcattttgctatagaaaaacaggttatagaaaataaaacaataactaaaatgaccgcacttacatcagaacagagagttattgcattagcaaaacttttgggggggcaaggcattggtgaaatggcattagctaatgcacaagaaatgttggatttagtcaatataaattaaatttcatttcgtatatttcaccaaaacggattatattgtatccgattttagatctgatctattaataacagactctagcctcagtacataaaaatgcttatgaagtaaatagctgatactgtttcacttatattaattctattgtctgaggtagagaaaaccatacagcacggacttcacatcgatgtttttaagtctgattttttaaccctatataacctcgtttttgcaaagttgcttctttggattttctgatcattgtttctattgtcgtgccttgaattaaaattgaaaagagaacaacgctgtaagtaataataataaataaatctcgcacattcataccgatattttctaaaaatgcacttgttgcaggaatagaaagtgccatggcaagagagagaccgcctcgtaagcctccccaagttaaaattcgtaaagtataaggattgtacacagttttcatacttaagaatttgaatgggatccatacgcttgcataacgacaaaataaacataccggaatagcgactagacttaagatgatcgcttgtgaagtaaagttcaccaataacatcgcagagccaattaataagaataaaagtgaatttaagaaatgatcaatcatttcccaaaagtgatcaagatagtgttgactttgttctgaaaaaccggagtgtcttgtccagttggaaatcataattccggctacaaccattgccaaggcaccagaaacatgaagcaaatttgctaacataaagccagcagtaggaatggttaaagtgagtaagatttctaaacttccgtcatcggtagctgaaatcagaaaatgagcaataacacctaagattaagccaaagaaaattccaccaacggcttcagctaagaagagttttgtaatctccattgcagttggctcatgtccaccaaatgcaacggtaaaaatagtcgtaaaaataactaatcctaccccatcattaaataaagattcaccctctactttcatggataatttttttggtgcttttaagtttttaatgatggccaatacagcgatagggtctgtcggcgaaatgagagcgccaaataaaatacaataaataaaatctatatgcagttttaataaggcagatattccgtaaaataaaactccaataaagagagttgatgctatcgttgaaaacaaagctaatattgtgatctccaatttttggctttttaatacaggtaatttaattcccaatgcaccagcaaaaagtagaaatcccaagatgccatttaataggaaatctttaaaatcaatgcgttgcataacgttttgagcaatgtcgtctaaatggaataaattagtagatcctgcgattagtaatatcagtgaacctacagttgctgttgcggtgattgcaattgtgtattgaatacggtcactgattttttgagtgacaaaaccgattaaaatcgatatggtagagagaaaacaaatgtaagtataaatactcataagaagtaccttctaaaatttaaaaatctgtttatattttattaattaatcaaattagtaaaatataaacagacttgacttgttctaattgagatagtcaagtagcgattgggcattagaaagttaataaaatgtaacaagaaaaatttttgcctagtataagtaaagtcctactttttataaagttcatttttataaaataattagaaatagttaatttatagcgttattttcgaccgcacttttgatatgaaaatgcttgtttaaggatagtaatggcagaataaattttgtttgttctgccattatatgttgaagaataaaaaattaacattttgcaacaataacaatttccactttccatttcgggtcagccaattgactttgcactgtggctctggtaggtgcattatgagaatcaacccattcatcccatgccttattcatttcttgatagtcttgcatatcagctaaaaaaatttgtgcattgagtatgttgcttttatcggaaccgatttctagtaataatttatcaattagacctaatacttcttttgtttgtaaataggcatctacatcagtattttccggtacttgtccagcaaaataagcagtattattgtgaatcgttatttcagatagccgtccgttagaatgaaagcgttgtattttttccataatgtctccttagtgaataatgaaattatgtataaagattatagcgatttttgtaaaaatggactaggatctgcaagtttttcttgaattattgtagtggaaaattttgtgtgaaaatgctgatttctaaccaacatggtgcaactttaatggcattaatgccatttttatatggtatgcttttggctaaaccgacttggcagcattcctttttatttttggcttggtttagtctatatttaatgagctatcctttttttcatttgttcaaaggtaaaaaatcgaattttataaaatatcaaaaatacacattgatttatggcacgacaagtttgatatttgcactacctgttttttactacaattggcacattttatattttcttatcgcaatgttaccttttggcttcatcaatatttattttgtaaaacaaaaaaatgagcgagcattaattaatgatttggcggggataattatctttgctattgccggtatggcaagctattatttttctacttttacctttacccaacaaatttggttagttgctttattgccaagtttgtatttcatcggcactactttgtatgtcaaatcttgtttgcgtgaacgaaaaaatcctaagtatttattggcttcttacttgtggcatgttgcttgtgttgttctttttgttgcaatacaacagttttatcttgcatttgcttttgttataccggcaatacgtgcctattttttaccgaagatgaagatctcagctaaacaactcggtttaattgagattgcggtagcccttgtattttttattcaacttctttttgccactttatagagaagaggactactatgaaattactaatgttatgtcgagaacctcgcctttacagttgtcagcgtttaaaagaaagtgcggaagataatgggcatcagatagatattctagatcctaatcgttgcttattaaaactctcgaaaaatgcaccgcactttgagttgtattatcaagtgaatagtaaaagcgagccgtatttattaccggattatgatgcgattattcctcgttttggttctacaagcacaagaatggggtgtgccgtgttacgacattttcgtacaaaaaatgtattttgtttaaatgatgatgttgcgtttttaaaagccagagataaatggcttagtttacagttattgactgaacaaggtattgctgtccctaattcagcattgtcaggtgcagaattttctgccactcaagccattttgcaaattcaatcgccgacgattttgaaaacgttacacggttcacaaggaataggcgttattttggcagaaaatcgtaaaagtgcggtgagtattatggaaactttaactcaagcagacgtaccgttattaatgcaggattttattcaggaagcacaaggaacggatattcgttgttttgttattggtgataaagttgttgctacaatgcaacgtattggacaagaagatgaatttcgtgccaattttcatcgagggggaagtgcagagaaaattcagttaaccgaacaagaaaaagtactagctttaaaagcaacgaaatgtttagggctagatgttgcaggtgtcgatttgatccgttctaaacaagggttgttagtgctagaagtcaatgccagtcccggattggaaatgatcgaaaaaaccagtggaattgatattgccttgcaaatgatagttcacattgaaaagcagtttaagagataatgttttgctcgtagtgcggtagaaaaataccttgttttttgttttaataatgaaatttaaaaaatcccgatatttacaaaggattcacaccttaacatactgaataaataggttaattatgttcttttggtatcaaaatcacgttatagctaagttacttgtttggctgttattcccattttctttggtcttttggtttatttctgttattcgtcggagattatttcgattaaactggctgaaatcctaccgctctcctgttcctgttttgattgtgggtaacttatctgtggggggaaatggaaaaacacctgtaacgatttggttggtaaaacaatttcagtcgagaggtattaaagttggcgttatttcacgtggatacggtagccgagcagagtattatccatatttagttaaaattgatgataatccaactatttccggtgatgaacctttgttaatcgcacaacgtacaggcgtacctgtttgtatttccccgaatagacaacaagcaattgagcttttactggcacagtttaattgtgatttaatcattagtgatgatgggttacaacattataaattacaacgtgattttgaaattgtagtgattgatggcgaaagggtatttggcaatggttttgttatgccggcaggacctttaagagaattaccaaatcgtttagcggaagtggatttaattattaataatggaaagctaacaggttatagtaatacgttcatgctcttattacctaaattcgccgttaatttagtcagtggtgagaaaaaactattacgtgattttcaacgtattcctctcaatgcaatagcaggtattggttatccgcaacgtttttttaatatgttacgagattttgcgttaactcttgaaaaaacgcaaagttttcaagaccatcaggattttgatgcagtacatttctcatatttctcttcaaatcaaccgctctttatgacggaaaaagatgcggttaaatgtcgtccttttgcacaggcgaattggtggtatgtgccggttgaggctgatattcagggagaagaggtagaacgatttatgcaagttgtttcacaacaaataaaggagaaaaaatgaacggaagattattagaaattgtcgcatgtccaatttgccaagggcgattgaaatacgacagtgaaaatgagcaacttatttgtcactttgatcatattgcttaccctattaaacaaggtattccaattttactttccgatcaggccataagtttgtctacatctttaaccaatcctgagcaacaaaatcagtaataaggagaatattcatgaatttcacggttattattcccgcacgttatgcgtccagtcgcttaccgggtaaacctttggctgacattgctggaaaaccaatgatccaacacgtttgggaaaaagcacaacaatccggtgcaacaagagtggtcgttgcaacagattatgaggaagttgcacgagcagttcgtggttttgatggagaagtttgtatgacttcctctcagcataattcaggtacagaacgtttggctgaagtgatagaaaaattagctatacctgatgatgaaattattgtgaatattcaaggtgatgagcctcttattccccctgttattgtgagtcaagttgcacaaaatctacaaaaatatcaagtgaatatggcaactcttgcagtaaaaattgaagatgtggaagagttatttaatccaaatgtagtgaaagttttaacagataaagatggttatgttttatatttttctcgtgcagttattccatgggatcgagatcagtttgttcaactgggtaaagcagatttatctcaattgcaattgcaccaacattatttccgtcatattggtatttatgcttatcgtgccggctttattaaacaatatgtacaatggcaacccacaacattggaacaaattgaaagacttgaacaattgcgtgtcctttggaacggtgaaagaattcatgtagaattagcaaaacaagcacctgccgttggggtagatacggtagaagatttagaaaaagtgcggtctattttatctcatgtttgatgccaaaaactttcttgccaatgtaacgcaccagcccggtgtataccgaatgtttgatgaaaaagggcaggtgatttatgttggtaaggcaaaagatttgaaaaagcgtttatccagctattttcgcactaatttgaatagtaaaaaaacttccgcactggtttcgcatattcattcaatagaaacaacaatcaccgcttcagaaactgaagcattattgcttgaacataattatattaaagcttttcagccccgttacaatgttttattacgtgatgataaatcctatccctatattctattaacgaaagaacgtcatcctagaattacctcgcatcgaggttcaaaaaaagtacaaggtgagtattttggcccttatccccatgcaggagcggtacgtgaaactctctctttgttgcaaaaattatttcctattcggcagtgtgaaaactcggtatataacaaccgctctcgcccttgtttgcagtatcaaatcgggcgttgcagtggtccttgtattgatggtttagtatctgatgaagaatatcagcaacaggtcgattttgctcggctatttttacaaggtaaagatcagcaagtgttggagcatttgatcaaaaaaatggaacaagcgagtatgcaacttaattttgagcaggcagcttatttccgtgatcaaattcaggcgattcgtgcggtaattgaaaaacaatttgtttctaacgaacgtttagatgatatggatattctggcaattgcttatcagcttggtattgcttgtgtacaagttttatttattcgtcagggaaaagtattaggtaatcgcagttattttcccaaagtgccggcaaatacggatttaagtgaattaaccgaaacgtttgtcggacagttttatttacaggggcatcaaggtcggattataccaagtactattattgttgatcatgttttgaatgaaaaacatgaacttgaggttttattaacagaacaagctggacgtaaagtaaatattcaagataatgtgaaaggcaataaaagcaaatttttacatctggctcaaatgaatgcacaagccgcattagtaacacagcttaaacaagctaatttaatacaagagcgttatcaggcattacaagaacttttgtctttaactaccattaaacgtatggaatgttttgatatcagtcatactatgggagagcaaacaatagcttcttgcgttgtttttgatactgaaggaccgttgaaatcagattatcgtcgtttcaacataagcggaattactgcaggtgatgattatgccgctatggagcaggctttgttgaaacgttatgatcgcccattagaaaatgagaaaattccagatattatttttattgatgggggaaaggggcaattaaaccgtgctttacaagtttttgcacaattaaatgtatcttgggataaaaataaaccgctcttaattggggtagcaaaaggggtagatcgtaaagcaggtttagagacgttaattattagtaaacaaaataaggaagtgaatttactgcctgacagccttgcccttcatcttattcaacatattcgtgatgaaagtcatcatcatgccattggcggtcatcgtaaaaaacgtcaacaggcttttactcaaagcggtctagaagccattgaaggcgttggagcaaaacgaagacaagctttattaaaatatttagggggtatgcaaggtgtaaaaaatgcgactttagcagaaatttcctccgttccgggcatttctgctgcgttggcggaacggatttatgaaacgctaagaagtgaataagcagtaacaaagcaaaaggggaaaatatttaatttccccttgttttatctataaaatcagcaaaatcaaagaatgatgtttccattatcatctgccggttttgttagcccgataataaattcaatgagtgcgataaaaccgggaatgaaagtccaacagaataaaagatataaaatacctaatcccgttttaccggcataaaatttatgaatacccaatccacccaagaaaaatgccagtaagcaataagcaattttattcaccggtttggctgtttgagcataggtattttttgtttttaaaataacaggtgcttcatcagtaccgaatacatcgacttcatctctgacctgtggttcaaaatccaatgctgttcttggtacttctttgatagaaccatcaggcataccaatagacaccatattatcttcaatttttataattttagccataacattccctcttagtgttattagttttaattaattaaaatttttaaaagccaaagaagaaaaatctgaataagagaattttttcattggctcaaaagtgcggtttattgtactcaacctagaattagttagcaatatttccaataatgcttctcgtttcttctttaatgtccacaagttgaacatgaattatatcgccaattttgtatgttttttctcctttaatataaagtgcaatttcctcggcatttacctgaagttcttctctattgctgtgtagggttgatgccggaataaagacggaagctccattttccaatagaagtacacgtaatccgccacgcatgacatcttgtatttcagcttggaatacttgcttttgttccactttatctgctaaatagcgacaatataaccaatctgcaatatctcgctcaactaaacggttttgacgacgagcctcttgtaaacgttgtaagatactatcttgagggcgttcatattgttgtgttgtgagacttgctttaattaggcgatgattaactatatccgaatatttacgaattggagatgtccatgtggcgtaaccttgcaaacctaagccaaagtgcggtgctaattccgttttaaattctgctgaggttaagaaacgacgtaaacgcaattcaagataattattttcgcttgctccaatatcatgacgcatattgcagtatccacttaaggttgctaaattttctacagaatagcgttgttttaattctgcttgattttgttcgctggttaaatttgacagcaggaaatgatgtgcattttccaagaattttttatcgaaaccactatgagtattaaaaatcccaaaaccaattttttcattcagatattgtgccgcacaaatattcgcaataatcattgcttcttcaacaatttggtttgcaatgcgacgatattctgttttgatctcttgtactttaccattttctgccagtacaaaagagtagtccggtttttctttaaacagtaaagcatgagttttacgccattgtgatctagctaaggtaaactcatgtaaccatgcaatttgttgttgagtaacaggatcttgtggttgccaacagcctgttttttgttctaaataatcagacactttatcataagctagtttagctttcgacattacataagcagagacaaagtatggtgtagcggtaatttcaccttgtaaatctgttgtgatataacaaaccaatgcggcacgttgagcattttcggaaagagagcaaagatcgtcggataactctcgaggcaacattggaatattaaatcccggcaagtaattagtgaaacaacgttgtctggcatcttgttcaatttgtgaattaacatcaatataagcagttggatcggcaatcgcaactactaatttccagccgacttgagcttcattttcgttgattggctcaatatataaagcatcatctatatcttttgttgtttcactatcaatagtgatgaagtgaagtgcggtgagatcttcacgatcttgttgatccaacatgtggtaactttcttgtccctgtacaggataacgagattgttcatgatgtgccaaagttacccaccaaggtgcaagttcatcatcagcgtgacaaataaattcagaaatgtgtgcaaagaaaaaacgatcatcacgtaaaggatggttttttagctgtgccacaacccaatctccctcttgtaattcttctttaacggcttttgtttgtgtcgctccaattggttgattaatttgggggtgatcgactacaagttgtaatttcttgtctttattgaaccgcactttggcaataaagcgagttagcatggggtcaatgagttcttccggttcagcttgttctttatcgccaatcgtttcaatcactgctttaattttgtcgccatgcataacttttttcattgccattggcggaataaaataactttttttatcacactcaaggaaaccgaaggctttgtcagaacctcttacaataccttctacatgcggtttactatcacgaatttgttgtttgagttgggaaagtaggggattattttgaaacatattcttacgctataaatgaaaacggatgttcagttgaacatccctagaaaagattaaatgtagattattctgcacctaagtcgcccatggcagtaatgctaaaaccggcatcaacatgcaatacttcacctgttatacctgaagccaattctgagcataagaatgcggctgaattgcctacatcttcaatagttacggtacgacgtagaggggctgtgttttcaaaagtggccagcattttcttgaagtttttaatgcctgatgccgctaaagtgcggattggaccggctgaaatagcattgacacgaataccgtctttacctaagtctgccgccataacacgagttgccgcttcaagagaggctttagctaaacacatcacattatagtttggaatggcacgttcagcacctaaataagtcaacgttaataagccggcgttttgatttaacattggacgggctgcttgtgccattgcaacgaaactgtatgcactaatatcatgtgcaatgcgatagccttcacgagttgccgcattgacatagtcgccgtcaagctgatcacccggagcaaaagcaatagcatgtacaaaaccatcaaacttgtcccaatgctgttttaattgtgaaaaacatgccttgatgctttcatctgttgcaacatccaaaggtaaaacaatagtagaaccaaattcttgtgcaaattcttctacgcgtgcttttaatttatcgtttaaataagtgaacgctaattcagctccttcacgtttcattgccgttgcgataccataagcaatagaacggttgctggccaaacctgtgattaaaatgcgtttacctgctaaaaatcccataataaaaccctttattcggttagttaaaaagtcggcatagtataagtcaaaatgagagaaaaaacaaaagacgcaagagtacgctgatctttaagctggattatcaatatctttaaattcaacttcaaaaccgtattcttgagctagccattcgcctaaggccttaataccataacgctccgttgcgtgatgaccggcggcaaaaaaatgaatgccttgttctctggctgaatggatcgtttgttccgatacttcgccggtaataaaagcatctaatccttttgttgcagccaaatcaatataaccttgcccgccgccggtacaaataccgacagttcggattaagtgcggtgcattttcaccacaaaataagggtttacgccctaatgctttttcaatgcgttgagccaattcttcaccgcttaccgtctcaactaaatcaccataaacaggaatactgaaactaccattttctaatgggcgtaaattttcaatacctaataacttcgcaagttgtgtattgttacccaactctgcgtgtgtatctaacggtagatgatacccatacatattgatgtcattttgcaacaaggttttaatgcgtttacctttcattcctcggatgcaaggattttcatttttccagaaatagccatgatgaaccaaaattgcatcagcttgttgtgcaacagcataatcaattaacgcttggcttgcggttacaccggtaataattttttgcacattggattttccttcaatttgtaaaccgttgggtgcataatcggagatattggcactattgagtttttggttgataagttgctccagttcaagattattcatattgttatccatccaattaaattttatttaatttcagttccttttaataacttacgtatccaactgcgatttgggctgagattatgtagaatatcttcgctcaaagggagtggttccgcataaatcagagaggcaagggtttcacctaataaagcggctgaagttaaccctcttgagcctaacgcaccgatgagatataaatttttccattgtgctgcatcaggaataggctgtttacgacgacgtaaattgaagatgtttcggtagtctaaacattgttgctcaaaatgaggtacattccccataatcggcacacgatcacgcactgaacaacgaacacctattctagctatattggctgatatatcaatatcctgcaaccaatccatgtttttatccgtatcggtagaagctagattttgttgaattttttgctgattttcccgttgttcttgatggctaaaatggcgatctttgttattgcgaatatgacttgcaccaaggcaatgactctgtttcattttatccgctggagttaaatagccatcgtaacaaagtacggatttaagtttcagtaaattttcactggtcggaatttggctgacttgacctcgtacgggataaagaggaagtttagctgtttgcacaaaatctgtaatttgataaccattggcgagtacaacaacttgatgattaaaggtttcattttgttcattggttaaaacccattgtaaatttcggtagtcaagtgcggtaattttttgtgaggttttgatctctaatccaagttgttgtaagtaagaaaaagcattttgcacaaattgacgtggagcaagccaagctccctgcggaataaaacctcctgcacaatctaaaggaagccctattttttcacttaactgctctttatttaaattctgatacaagctttttgaccattgataagaagaaatttttgccaatttaaccgcacttttgtgatcgtaagcacaaagtgctacaccacaaaattcatgttcaaattctataccttgtttaattgcccactgcaattgttgtaaagcatagaaaaaggcatgaacataaaagcgaatattgcgatcatcgtcatcacttaattgaggataaaaagcaccttgtttgttaccggaggcgttgagggcaagttgctcatcttcacaataaagagtgatttttgcccccctttttaatagtgaaagtgcggtgaaaagtgaagcgattccgcctccgataattgcaatgtcttcagaaagtaatgaggcgggctgacttaagtaccaaggggcttttgtattttgttgtggaatagcatttttaataccacataaacattcccgctttttgccgtaaccttttcgtttttgtacttcgaatccggcagaaactaatccttttctgaccgcacttgcagcggtaaatgtggaaaatgttccttgtggcttgctgtaatagaacatctgttgatagagttcatcattccacatttgtggatttttactgggtgagaaaccatctaaaaaccaagcatcaatacgattttgcatataatcacccagttggggcaaattatcgacaatatcaccaaaccataaatccaatgttgtttcagcaaaatgaaaacgctgacaaccttgtatcgcctctaagcaataatcgcataattgttgtgataaagcagaaaattgtgggtaaaattgatgaatttgttgtagttgaactttgggaagagggtatttctcaaaggaaataaaaaataaatgtttaagtggggaatgagaatattgttgccgaaattggcgaaataaacttgttacggcaagaaaatttaaacctgtaccaaatcctgtttctgcaatgacaaaatgtttttcttgatagacaatccagcgttcccataaatgattaccttgctgaaatacgtattcgctttctgctaaaccgtcttggttggaaaaataaacgtcattaaattgttctgataccggtgttttttcttgattcaggtaaattttggcgggcgtaactgtaaacataatatagctaatttttttgttgcattcatgatttttgctataatagcgaaaattttttcactggtcgaacattcgaagaaagacttgaaatattttcattttatagtaagttgacgaccgattattttattctttaacgtaaaggaatgtttctatgagaagagccgtggttacaggttttggtattatttctagtattggtaacaataaacaagaagtgttagaagctttaaaaaaagggaaatcaggtattgaagtgatgccggattttgtcaagatgggcatgcgtagtcatatagcgggaacaattaaattaaaccctgctgaattaattgaacgcaaaattttccgttttatgggagatgctgctgcttatgcttatctctcaatgaaagaggccatcgaagatgctggattgacggaagatcaagtttccaatgatcgtactggacttgtcatcggagcgggaacaggatccggtcataaccaaatggttgcttgtgatgctgtaaggggtccaagaggcgttaaagctattggaccttatgcagtaactaaaacgatggcatctagtgtatcggcttgtttagcaacaccttataaaatccgtggcgtgaattattcgattagttctgcttgtgctacttctgcacattgtattggacatgccgtagaattaattcaattaggtaagcaggatgtggtttttgccggtggagcggaagaattatcttgggaatgtgcaactgaatttgatgcaatgggagcggtttcaactaaatacaatgaaacacctgaaaaagcttcacgtgcttatgatgctcatcgtgacggatttgtgattgccggtggcggtgcggtagtcgttgttgaagaattagaacatgctttagctcgtggagctaaaatttatgcggaaatcgttggctatggtgctacatctgatggatacgatatggttgcaccgagtggtgaaggtgcggagcgttgtatgaagcaagcattggcaacagtggatacgccagtggattatattaatgtgcatggtacgtctacacctgtcggagatgtaaaagagttaggtgcaattcgcaacgtatttgctgatcaaaaacctgccatttcttctacgaagtcaatgacggggcattcactaggtgcggcgggggctcatgaagcgatttatagcttattaatgttagaacatgattttattgcacccagcattaatattgaaactttagatgaacaggcggtcggtatgaatattgtgactgaaacaaaagagaacgcaggtcttgaaactgttatgtcgaacagttttggtttcggtggaacgaatgcctgcttggttttcaagcgttataaaaaatagagataattcttttatagtgatctatctaatgatttagacagatactgttcttttagatcttattttaaagaactattttagatattgaagtgagctgcctctaaaagttggacggaataaccaactgattagaggcagatttttatgattaaatgcaaaacaacaaactactgagtagtctttttatatttttagaatttgttttatattaaaattatctctttatctttaaataaaaatttaataaatatcaagtttaatgaatataatttttaataattgttattttgataaatttaatttaatgatattatcttaatgctttaatatggaaggttaaatcctgaaaagcaaagtattgaatacgatgttgctattaagcgaacttttatacgcatgaaacaggtcgtggcgtcttttgattttttattttattgatgtggttattatgaaaaaatttattttactcggattattactttctttttcttcatcaagcattgctgagttatctgattggattaagccgatttcggatatctcctccggagatactgcatgggtgatgatatctgcaatcttggttttatttatgactatccccggtttggcattattttatgggggaatggttcgtaaaaagaatgtgctgtcgacaatggcacaaagttttgcggtaagcggtttgatagctgttatttggttgtgttttggttatagtctttcctttacaccaaataatgcttttattggcggaatggatcgtttttttctgcaaggtttaaatgtgtttactgaacagaaaatgcttactgtttatcctggagctggaacgattccggaatctgtttttatgatttttcaaatgacctttgccattattgctggagcgatcattacaggtgcgactgtagagcgtatgaaattttcggcattattgttatttgttggattatggtcacttttgatttatgttcctaccgcacattgggtatggggaataggtggttggctagtaaatgatggggtattggattatgccggtggtaccgttattcatattaatgcaggtgtagcaggattagtcgctgcaattgtcattggtaaacgggtcggttacagacatgaagtgatgatgccgcacaatttagtattaactcttataggtacggcaatgttgcagattggttggtttgggtttaatgcgggttcggcacttgctgctgatgcaagagcgggtatggcattagcaactactcagatttcagcctcggtcggagcattaacttggatattagtcgaagtattttgtaaacacaagccgtctgcgttgggtttggcatcaggagcggtagcagggttggttggtattacgcccgctgctggttttgtatcggtacaaagtgctttattcataggtatgataacaagtgcggtctgttttgtcggtgtaatgaaactcaaatattggtttcgatacgatgatacgctcgatgcgtttggtattcacggtttaggcgggattgtcggagcggtgttgacaggcatattcgtatctcctgatatttcagccaccgaaaccacactttggacacaaattgagagtgtattaattactatcatttttagtgcctcaggtagttttgttttattaaaaataattgacaaaaccgtagggttacgagtggagcgagatgaagaacgtcaaggtttggatttaagttgccatggtgaaagaatagaatagttaaaaaatgaccgcactttacgctttataaagtgcggtcagattatagtagctatatagtttgaagatgaaattcgaacacctattatttggcgttaattaaataatttttccctccagtatccaaattcttttaacaattgtgagtttatattcaaagaaattgcttgtatttgtacttaaatcgtgaagttagtcgttgatggttgtagaaaaaataaaagttacattctaaaagaagatccaaaatttaaacacgcaatagatagttttgaatggacagcttagccttgtggtaggggcttgccctcgttctctgttttttgctatcaacctattttcaggtaaatacagagaacccttctcgactagtttggatttaccgagtaatcaataagggaatatgcctgaaaaaatggttcatttcttaattgttagcatactattatcaagctgcatgagtactgctataaaattttaggataatttaggataataatgggggaactctctcaaaaagaagccaaaatttttgatcaatgtcaggagggggtaatcaattaaaaagtaataacagatttaaccattaacttttaatttacggagatatatgatgaacagcgtgaacaattcaattttttaacgaactaacccattcgtcaaatgtaatatcactcaaattaagaattttgaaaaagatttttcaatcaaaagtcctgaagattatagaaattatttatgctatttaataatagcggagctagtgttcatcatatgtatggattgcataattatgagacatgtagattttgaatggaaaaaggcatgttggagtatgaacaggggactttagatcggttattatgatttggagcgggaaacgaggctcgaactcgcgaccccgaccttggcaaggtcgtgctctaccaactgagctattcccgcatattcctaaagaacggagcgtattatacaaatattttactaagaagcaaggttaaaatttaaaaaaacgcaaccttgcttgattattggttgaattaattatctgtttgttaagttaataaaggtattcctataatgagctaattcagcaatggattcacgaatatcatctaacgccaaatgtgtgttctttttttcaaagctatttagaatttcaggtttccatcttgatgcgagttcttttagtgtgcttacatctaaatgacgatagtgaaagtattcagctaattcaggcatgtagttgattaaaaaacgtttgtcttgagcaacgctatttccacaaataggagaaacacctttaggaacccatttttttagaaaatccaaggtttgtaattctgcagcccgttctgttaatttgctgttttttacccgttcgattaagccgttagatgtatgagttttcacgcaccattcattcatgttattgagaagttcgtttgattgatgaatggctaaaacaggaccttcagctaaaatattgagatctttatctgttacaattgttgcgatttcaataatccgttctttatcaggatctaagcctgtcatttccaagtcaatccaaataagattttgtttatctaattgcataataagagtatcctatacaaaatttcttatattctaactgaaaaatgaccgcactttaaggatttctctttgagcaaacgtaaattaacccaaaatcaacaacgtcgaattcaatctaataatgcaaaaacattacatcgtcatcaacatcggcacaaatcagatattgattggcaagatgatatgcttggtgattttcaagatggaacggttgtgacaagatatgctgttcatgctgatgtagaaaatgaacaaggtgaaattgttcgttgtaatttacgccgtacattgaaaagtgtcgttgtgggcgatcgtgttgtttggcgtaaaggaaagacacaactacaaggtgtaagaggggtcattgaagcggttcaaccacgacataatcagattgtacgcccggattattatgatggcttaaaatcgattgcggctaatattgatcgaattattattgtttccgccgtattaccaaatttatctctcaatattattgatcgttatttagttgtttgtgaaagttcgaatattcctgccgttattgttgtaaataaagcagatttattgagtagtgaagctcgaacagaagttagcttacaactcgaaatttatcagaaaataggttatgaaacgttattaatctctgccaagagcggtgaaaatatggataagctaaccgcacttttgtctgagggaacgtctatttttgttgggcaatcaggtgtgggtaaatcaagtttaattaattatattttgcctgaagtgaatgcacaaactggtaagctcagtcaagtatctggtctaggtcagcataccacaacatcttctcgcctatatcacttatcacaaggaggaaatttgatagattctcccggtattagagagtttggtttgtggcatttagagcgagatcaaatcacgaacggttaccgagaatttcagtattttttgggaacttgtaagtttcgagactgtaaacatttgcatgatccggggtgtgctattcagcttgcagtgaaagaaggaaaaatcgatcctttacgttttgaaaattatcatagactaattacaagtttgtccgaaactaaatctcaacggcattttatatcggcgaattaagttaaagaagatattttgtatacttaataaacaacttggagctttttttgtgatgtagttcaaattttaatgtggtttaccttgattattctgatttgaaacttgatactatgcgtctgatttatttttttatttaaaataaatatgaactgacactaacgaattgtttttgaagcgttaggatactacatgtagaatgatttaaattaagaggatacagttatgtactcaaaagatgttgaaattactgcaccaaatggtttacacactcgtccagctgcacagtttgtaaaagaagccaaagcgttcgtttctgatattacagtaacttcagcgggcaaaagtgctagtgcaaagagtctatttaagttacaaaccttgggattgactcaaggtacagttattacgatttctgctgatggtgaagatgaacaaaaagcggttgaacacttagttgcattaattcctactctagaataatcaatatatttattagccataacttaatgttttcataaataataagtttatggctattgtgttatttagcgtattgtaatttaaaattattttggaaggttaatatgatttcaggtattacagcatcaccaggtattgtatttggtaaggcactggtgcttaaagaagaaaagattgttcttgatacgcaaaaaataaaagatgagcaaatagacattgaagttgctcgtttttatagcgggcgtgcggcagctatagagcaattgattgcgattaaagatcgtgctttagtctctttaggtgaggaaaaagctgcaatttttgaaggacatttaatgatccttgaagatgaagaactggaagaagaaattttagattacttacgttcaaataaggtcaatgcaggcgttgctgcaagtaagattattgatcaacaagttgctatgttgtctgaaattgacgatgaatacctacaagagcgtgccggagacattcgtgatattggtaatcgtttgattaaaaatattttaggtatgaaaatcgttgatttaggggatattaatgaagaggctattttggttgcttatgatttaaccccttctgaaacagcacaattaaatttggataaagtattaggcttcattacagacattggtgggcgaacatcacatacttctattatggctcgttctcttgaattgccggctattgtaggaaccaatgatatcacttcaaaagtcaataccggtgattatctcgttcttgatgcggttaataatgcgatttatgttaatccgacacaagaagaaattgagcgtttaaaagctttagaacgacaattagctgaagaaaaagcggaattagctaaattgaaagatttaccggcattgactttagacggatatcaagtagatgtggtagctaatattggcactattcgtgattgtgagggagctgatcgtaatggtgctgaaggcgtcggattatatcggacagaattcttatttatggatcgtgatcagttgccaacagaagaagaacaatttattgcttataaagaagttgttgaagcaatgaatgggcgtttagttgtgttacgtacaatggatattggtggagataaagatttaccgtatttgaatttacctaaagaaatgaatcctttcttaggttggcgtgcgattcgaattggtatggatcgtcgtgaaattttacatgctcaattacgtgcagtattgcgtgcgtcagcttttggtaaattagctgttatgttcccgatgattatttctgttgaagaaattcgagaattgaaatctgtgattgaaagtttgaaacaagaattacgtgatgagggtaaggcttttgatgagaatcttcaagttggggtaatggttgaaacaccggcggcagcaataaatgcaaaatttttagcaaaagaagtagatttttttagtatcgggacgaatgatttaacccaatatactttagcggttgatcgtgggaatgaattaatttcacatttatacaatccgatgacaccggctgtattaaacttaattaagcacgtgatagatgcatctcatgaggaaggtaaatggactggaatgtgcggtgagttagcaggcgatgaaaatgccacattgttattgttaggtatgggattagatgaatttagtatgagtgcaatttcgatacctcgtattaaaaaattgattcgcaatgtgaattatcaggatgctaaattacttgctgaacaagcattacagcaaccaactgcggcaggtattttgagcttagttaatgattttttagtggaaaaagcacttaattaatatcatttgataaaaaattacgctagaatagtgcaattattcatgagtaggagaaagtttaaatggctttttttgataaattatttggttcaaaggaaagcaaatctattgatgttgaaatttatgcacctatatcaggtacaattgtaaatattgaggatgtaccagatgtggttttctctgagaaaatagtaggtgatggcatagcaattcgtcctacggggaataagattgttgcacctgtagatggagtaatcggtagaatatttgaaactaaccatgcattttcaatagagtccaaagatggcgttgagttatttgttcactttggtattgatacagtagaattgaaaggtgaaggttttactcgtattgttcaggaaggtcaacaagtaaaacgtggtgaaacaattattgaatttgatttggcttcattggaagcaaaggcaaaatcagtattaactccgctggtaatttcaaatatggatgaaattaatagtatggataaaatgtctggcgaggtcgtggctggcgagtcagttgtactcttgttgaaaaaataatgaatagtgttatttaaaacggattggtagtggctaatccgtttttttatatcaataaatttttaaggaagaacagcatgtgttttttctattttcatataaaaactactatctttatttcaaaaaatctaataacatttacgaaatttgttaagatttgtggcgtaaactagatttgattagtttcgttgtgagttttgctaacattatcagaattttagttatcaatccattgtttaatttagtgttataaattaaacgtaccttttaacttaacacaataaggaaaagactatgtcagatatattgaaaaatgacgtagatccggtcgaaaccaatgattggttattagcgatcgattcagtaattcgtgaagaaggtattgagcgtgctcaatatattatagaacaattgatgcaacatgcccgtgcaaattctgtgtcattaccaacgggtgtaagcacagattacattaacacaattcctccatcagaagagcctaattaccctggtaatttagacttggagcgtcgtattcgtagtgcaattcgttggaattcgataatgatggtattgcgtgcttcgaaaaaagatctggatttaggtggacatatgtcttctttccaatcttcagcaactatttatgaagtttgttttaaccatttctttaaagctcgtacagaaaaaaatggtggtgatttagtttttttccaaggtcatatttctccgggaatttatgcccgtgcattcttagaaggtcgtgtaacagaagagcaattagataatttccgtcaagaagttgaaggcaaagggttaccttcttatccacaccctaaattaatgcctgaattttggcaatttccaactgtatcaatgggacttggaccattgaatgcaatctatcaggcacgtttcttaaaatatttacataatcgtggcttgaaagatacttcagagcaaactgtttatgcgtttttgggcgatggtgagatggatgaagtagaatctcgtggtgcaattgcgtttgctgctcgtgagaaattagataacttagtttttgttatcaactgtaacttacaacgtttagacggtccggtaaccggtaacggtaaaatcattcaagaacttgaagctcaattcaatggttctggttgggaagttattaaagttatttggggacgccgttgggatcgtttattacaacgtgatacatcaggtaaattattacaattaatgatggaagttgttgatggcgattatcaaactttcaaatctaaagatggtgcttatgttcgtaaacacttctttggtcgttatcctgaaacagaagcattagttgcggaaatgacagacgatgaaatttttgcacttaatcgtggtggacatgatccattaaaagtatttgcagcatttaataaagcaaaacaagttaaagataaaccggttgtattattggttaaaacgatcaaaggttatggcatgggagaagcggctgaaggtcgtaatatagctcatcaagtgaaaaaaatggatatgtcaggcgttaagcatgtacgagatcgtttcaatgttccggtatctgatgcagaaattgataacttaccttatgttaaatttgcagaaggaacagaagaatataaatatcttcatgaacgtcgtcaagcattgaacggttatttaccgactcgtttacctcgctttacacaacaaatggatgttcctgcattagaagaatttgcacaattatttgaagaacaaagtcgtcctatttccactacaatggcatttgttcgttcattgaatgtattactgaaaaataaatctgtaggtaaacatattgttccgattattgctgatgaagcccgcacttttggtatggaaggtttgttccgtcaaatcggtatttataacccgcatggacaaaattatactccgcaagatcgtgaacaggtatcttactatcgtgaagcaattgatggacaagtattgcaagaaggtatcaatgaacaaggtgcaacagcatcttggttggctgcagcaacgtcatattcaacaaatgatatgccaatgattccattctttgtgtattattctatttttggtttccaacgtgtaggtgatttaatgtggttagcaggcgatcaacgtgctcgtgggttcatgattggtggtacttcgggacgtacaaccttaaatggtgagggattacaacatgaagatggtcatagccatattcaatcttctgttgttccaaattgtatttcttatgatccggcttttgcttacgaagttgctgttattatacaagatggcgtgcgtcgtatgtatggacctgaacaagaagatgtgtattactatatcaccacactgaatgaaacttatgatcaacctgcaatgcctaaaggtgcagaagaaggtattcgtaaaggtatctataaatttgaaacagtaactggtcaaggcaaaggtaaggttcagttattaggttcagggtcaattttacgtcatgttcgtgaagcggctaaattacttgctgacgatttcggcgttacatctgatgtgtacagtgttacttcatttactgagcttgctcgtgatggtgcgaatgcggatcgttggaacttattacatccaaaagaagaagctaaagtaccttatattgctcaagtaatgaatgacgctccggcaattgcttcaacagattatgttaaactatttgcagaacaggttcgtccatatatacctgcacaaagttatcgtgtattaggtactgatggttttggtcgttcagatagtcgtgaaaatttacgtaaacatttcgaagtaaatgcacattatgttgttattgctgcgttaaccgagttggcacagcagggtactatcagtaaagacgtagttgctcaagcaattagtaaatatggtattgatgcagataaaatcaatcctttatatgcataatcaatatttgaactgagcggatataatccgctcataaaaaaaggataagataaaatggctaaagaaattcaaattccagatattggtggagatgaagttactgttactgaagttatggttaaagctggagatactattatagttgatcaatctgtgattaacgttgaaggcgataaggcatcaatggaagttccatcaccggaagcgggtgtcattaaggaagttttagtaaaagtaggcgacaaagtttctactggaactccaatgtttgtattagagaatgcagaattagcatctactgagacagcatctgaaagtatgcaaaccgaaaaaacacaaagtgcggtagcgtctatcattgaaatttatgtacctgacattggtggtgatgaagtcaatgtaactgatattatggtttctgtaggtgagacagttgcagaagagcagtctattttaaatgttgagggtgataaagcctcaatggaagtgcctgcccctactgccggtatagtaaaagaaattttaatcaaagtgggagataaagtgtcgaccggttctcttgtgatgaaatttgaagttgcaggtgttgtatctgcagccgaaacagctcaagtttcttcttcagctgaagtaacaggtgaaagtgcggtgcaagatgtacacgttcctgatatcggtggtgatgaagtcaatgtgacagaaattatggttgcagtgggcgatagtgttacagaggaacaatctttaattactgttgaaggtgataaagcttcaatggaagtgcctgctccttttgctggtgtagtgaaagaaattttggtgaaatcaggggataaagtttcaactggttcattaattatgcgttttgaagtgcaaggaaaagcccctactctagaagcatcatcggcggtgacagagactaaagtggctccatctccagctgcacaagaaaatcaaatgacgccagtgtctcaagctgatgtgactgcaagtgcggtgtttgctcatgcaactccggttgttcgtcgtctagctagagagttcggcgtgaacttagacaaggtaaaagggacgggtcgtaaaggtcgtatcttaaaagaagatgttcaggcttatgtaaaagcggcaattaaagcggttgaaagtggcaatgtttctcctacatcagcaggtaatggtgctgtcaatggagcaggactaggcttgttaccttggtcgaaagtcgacttcagtaaatttggtgatattgagcaagttgagttgggtcgtattcagaaaatctccggtgcaaacttacatcgtaactgggtaatgattcctcatgttacgcaatgggataaagcagacattacggaactggaaaaattccgcaaagagcaaaatgtgttggcggaaaaacaaaaacttgatgtaaaaattacgccattagtatttattatgaaggccgttgctaaagcgttagaaaattacccacgctttaatagttcattatcagaagatgctcaaagcctgattctgaaaaaatacattaatattggagtggcggttgatacacctaacggcttggttgtacctgtgtttaaagatgtgaataaaaaaggcattattgaattatctcgtgaattagcggaaatttctaagaaggctcgagctggtaaattaaccgcatcagatatgcaaggtggttgttttactatttcaagtctaggaggaattggcggtacacactttacgccaattgtaaatgctccagaagtcgcaattttgggcgtatctaaatctgaaatgacaccggtatggaatggcaaagactttactcctcgcttaatgcttccgttatctttgtcttatgatcatcgtgtaattgacggtgctgatggagcaagatttattactttcattaatagtgtattaagcgatcttcgtcgtttagttatgtaaatactacgcctctaaatcttattagggggcgttaaaactgttaaagtgcggttgaaaaccgccaacttttaacgaggtaaaaaatgaataaagagattaaaacacaagttgtcgtcttgggagcaggtccggctggttactcagcagctttccgttgtgcagatttaggcttagaaactgttattgtagagcgattttcgacgcttggtggagtatgtttaaatgtaggttgtattccgtctaaagcgttattgcatgtagctaaagtgattgaagaagctaagtccttatccgctcatggtattgtttttggtgaaccaacaacggatattgataaaattcgtggttggaaagaaaaagtaattaatcaattgactagcggtttagcaggtatggctaaacagcgtaaagtacaggtagttaatggttatggtaaattctcaggaccaaatgcaattattgtggctggtgatgaaggtgaaacgaaaattacttttgataatgcaattattgctgccggctctcgccctattcagttaccatttattccacatgaagatcctcgtatttgggattctactgatgcgttaaagttaaaagaagtacctgaaaatctcttaattatggggggcggtatcatcggtcttgaaatgggaacggtttatcatgctttaggttctaaaattgatgtggttgaaatgtttgatcaagttatccctgcagcggataaagatatggttcaaatttatactaaacgcattgaaaaaaaattcaatttgttactggaaactaaagtaactgctgttgaagcaaaaggagacggtatttatgtatcaatggaaggtaaggctgcaagtgaaactcgtcgttatgatgcagtattagttgcaattggtcgtgtaccaaatggtaaattaattgatgcaggtattgctggcgtcgaagttgatgatcgtggctttattcgcactgacaaacaaatgcgtactaatgtacctcatatctttgctattggtgatgttgttggtcagccaatgctagcacataaaggcgtacatgaaggtcatgtagctgcagaagtaattgcaggacaaaaacattattttgatccgaaagttattccatctattgcttataccgaaccggaagtagcttgggtggggaaaactgaaaaagaatgtaaagctgaagggattaattacgaagttgctaagttcccttgggctgcgtctggacgtgcaattgcatccgactgtgctgatggtatgacgaaattgattttcgataaagatacacatcgtgttattgggggagcaattgtcggtactaacggtggtgaattgctaggtgaaattggcttggcaattgaaatggggtgtgatgctgaagatttagcactaacaatccatgctcatccaactttacatgaatctgttgggctagccgctgaagtttttgaaggctctatcacagatttacctaacccaaaagcgaagaagaaaaaataataatctagctcgctgagacaataaggcgatcttttatgagatcgccttatttttttgcaaaaaagtgcggtaaaaaatacggcactttttaggcgacaaattttatttgattttcttttggttttatttgatggattgtattggttactgtaccaataataggcaaagtttgccaattagatgttcttattgaatgtactttattatctagtgggaaaaaaataaattcattattttcatgcatcatgaattcataaatttgaaattggttattaagatctaaaacgacaagatcattcattgaaaggtaattttgtttttctacaataagaatatcaccttgctcaatattccaagcgagcagattaggattgttaacttgaataaaacaagtttgttgtgggtgtttaatacagtaaagattgagatctagttttttgtgtgaacttctattacgttcctcaatatcaatgaagaatggcataggttggtaagaaagtgtagtgtttatattgctgatattctgatttgcgtaacccatctttttctccaatctaagtatgttatatattaactgattatttatacaggtatatattactgtttttatatacatatggtcaatagcataatagaaatttttagaaatttgcagattaataaatgtattttattttataaaaattcaaaaaatgtttattttaatattttctttataatcaatttacgttatctttactaaaccttggtggatctatagatctgtatttttaactcaaaaaacacaacatttattattatgaataagtcatatttatactctttcttttttcatggaagtttggtcaagcgaatttctgttggtcttttattgggattgctgttagcattaattgctccatcattgcaaggtgtattaggttttaatcttgcagaaaaagccggttttttaggaaaaatatttgtgcgttcattgcgtgcagttgccccaattttagtttttttattggttatttctgcaattgctaataagcaattaggcacaaaaagcaatatgaaatctattgttgtcttatatttgctaggaactttcttagctgcattgacatcagtattatttagttttgcattgccgacagaaattgctttaaaaacgcaagaaggctctctttctccgccaaacgaagtatctgaagttttaagtaccttagtactgaacgtggtagataatccaattaatgctttatttaatgcaaactttattggtatcttattttgggcaataggtttggggatagccttacgctatgcgtcagatacgactaaaaatgtcatgaatgatttttcagaggctgtatctagaattgttcattttattattagttttgcacctatcggtgtttttggtttggtggctgaaactttaactgataaaggtttgggtgcattgcttgattatatgcaattactagttgttttaattgggtctatgctatttactgcatttgttattaatccaattttagttttttggaaaattcgtcgtaatccatatcccctagtatggacttgtgtacgagaaagtggattaacggcattccttacacgtagttctgcagcaaacattcctgtaaatatggaattgtcaaaacgcttaaaattagatgaggaaacttattcagtttcaataccgttaggtgctaatatcaatatggcaggtgcggcgattactattacggtattaacattagctgctgtacataccttaggtattgaggtctctttccctacggctgtattgttaagtgtagtggctagtatttgtgcttgtggtgcttctggtgttgctggcggatcattattattgattccattagcttgtagtttatttggtattcctaatgatattgcagcacaagtaatcggcgtcggtttcgtcattggcgtattacaagattcaacggaaactgcattaaactcttcaacggatgttatttttacagctgcggtatgctggagtgaagaaaataaaaattcatagagtttatctaatgtgaaatatagcgggtatgggtacatatccgctttttcattatacttgatagccttctgcatgaagtgataaagtagaaaaaatttcatctacgatgagaatgctttagcatcactgtactttttgctttgaaatggagatatccctctcataaaaacactatagttttcataagaataagttattttcaaaatatactaataatccatatggttattaatttttacaaaaactttctgttcaataatttaaaaaagaggaatataataggatacactagtttaatagtcaggagagaaatatgtatatcagtcggaatatggaacaatggaatgaatttcttgatttaatgagaaaagcatttgaacaaggcaaagaacaagaactacttactttgctacttactgctgatgagcgagatgcagttgcactacgcgttcaaattgtatcccaattactggataaatctttggcacaacgagagatacaacaaattttgaatacaagtgcggcaacaattaccagaggttcaaatatgattaaaattatgccacctgaatttatggactgggttaaacagcaactaaaccataacaataaaaacgaattaggtagcgattaataaaagggtagtaagagtgagactttaagtcatttttgtttactattttcctatacaaatgcacttctaaacagaaaacagtctttactataaaaaatttacgtcaaaaaaatctgacagtttcatacttaaagagaacactgccagatttaatttactgtatagtatgatgattatgcgttattaccagtgattttagccacttccgctgcaaaatcttcttcaactttttcaataccttcaccaacttctaaacgaataaagtttgttactgaagtattaactgattttaagtaatcaccgacagaaactgaaggatccataacgaatgcttgaccggttaaagacacttcaccagtaaatttcttcatacgaccttcaaccattttttcagcgatttcttttggtttgcctgagttgattgcaatatcaatttgaatttgacgctcatgttctacaacttcagcggaaacatcttctggatttacgaattcaggtttagaagctgcaacgtgcattgctacttttcttaattcttcttctgaaccggatcccgctactaacacaccaatttttgcaccatgtaagtattgagcaattacatcaccctctaaatactgaacacgacgaatcgtcatattttcaccaattttagcaactaacgcagcacgcttatcttcaaaatgagttgctaaggtatcaatcgttattcctttgtttgctaaagcgtaatcagcaacttcatcagctaaacctaagaagccggtatcttttgctacaaagtctgtttcacagttcagttcaactagaacaccaaaaccggaaccaatgcgtacacgaataacaccttcagcagctatacgacctgctttttttgcagcttttgcctgtcccgatttacgcatattgtcgatagccagctcaatatcaccatttgcttcaactaatgcttttttacactccatcatacctgcaccggtacgttcacgaagttctttaactaatgctgctgtaatttcagccatcttaaattcctctatccatttgattaaatagtatcggttttagaccgcactttatcgatataaaaagcagggaactaaaagccccctgcgtttaattaataagggcttacgcctttactgaattattctgctgctgcaaaaacttcttcagttaccgtttcttgattacgaccttcttttactgctgcggtagctgcagaaagatataattgaattgcacgtgatgcatcatcgttacctggaataacaaaatctacgccatctgggcttgagttagtatcaacaattgcaaatacagggattcctagattatttgcttctttgattgcgatatgttcatgatctgcaccgatcacaaaaattgcatcaggaagaccgcccatatctttgataccgccaagacttaattcaagtttttccatctcacgagtacgtactaacgcttcttttttcgttaatttatcaaaagtaccatcttgagattgggtttctaaatcttttaaacgtttgattgattgacgcactgttttccagtttgtcaacatcccgcctaaccaacggtgatttacataatattgctgacagtctaacgctgctgctttaacaacttcagaagctgcacgttttgtaccaacaaataaaattctgccgttattactcgcaatacgagttaattcaactaacgcttcattgaacattgggacagttttttctaagttgatgatgtgaacaccattacgaggtccgaaaatgaacggtttcatttttgggttccagtaacgagtttggtgaccgaagtgaacgccagcttgcagcatatcacgcattgaaacttgtgccataagataattttccttttgtttggggtttagcctccacatatcaagcaaatcgaccgtttggcaccccgatttacttctcatgatacgtgtgtgatttcgtaagttaattgttaaattgacaactcaaaataacgtcgcactttataccacaaagtgcggttaaaaactagaagaaactcttaaattttgcaaaaaaataatgcctgataacctcaggcactatttttacaattcgaagaaatgtaaacctgcttttactcttcattaatgaattttgtattaatttcaatactggctttttctcttaaggcttgaataagcaaattgcttaaactaaattgcttaatttttgctatttgaacgccaaataattgtttttgctcaggcgttaattggctatcttctacgttcattaactcaacaaaaacaatatctccaaacatatttttcgctacagatatggttgttttgcccgggtcaggttttttcattgagaatatcactttgcctaaaacaggatctttattatctgcctctctataaacccacgtttctttttctgaaaaatgaatataagacggtaatttgaaatcagttattgtattcatctctgtaacgattttctctgccatattaaacaacgtagtttcggctttctgacgttttaaataagtttcaatatctgctgttgcctcagctagtgtacgaatcccctcaggtttataatcaactacacgcagaagcacggaatgttgatcgccaacattgattgcctctgagtttataccgccttgcataagatcagaattaaaaatggcggtagcaatatgactataatttaattctggcggtaaatcttgacgagaaaaataatctgtttctttgatgtcaagcccagctactttagctgcttcttctaatgattgcgggttttcaaacgccttttcattcatttgtttttctaatgaataaaaagcatttgttactaaatcattacgcaatttagttgcaatttcctctctaacatcatttaattcacgggttttcatatccaatactttaatgatatggtacgcattatccactttcacaggttggctatactcaccaacatttaataacgtcaccgcactttcaaaagcaagaggcatcattccattcacaacccaatccaaatctccacctttttgggctgataatgtgtccattgaatataattttgctaaagcagcaaaatcttcgccattttgtaaattagcatagactgattgtgcttcttgttcagtcggtaattgaatatgagctaaatgttttgttatatattgagctttattatcttgataatattgtgcaatttctatatcggagatttttactttctgatccgcaatcgcacgagttaagtctagatattgcactttaactctttcaggtacagcaaagttagctttgttagcttgataatattgttcgatttcttgctccgttacagtttgtttttgcatttcgtcatctaaagatagaacagctaaacgaacatcacgacgttggaaaaaattctttgctaattcattgagttgtataggaacctgaaaatcactatttgcaataccttgctgtaattgctctaataccaagccttcacgcacatatgcagcataagtatcagaactaataccacttgaagctaatatctgctgataaattttattgtcaaatttaccatcattttggaacataggtgagttcacaatagctaaacttacttgcttatcgctaattcctaacttaagttcttgtgcatattgacgtaataattcttgattgattaaacgatcgagaacttcatgtcttagatgtttagctgccgaatctgcaacttcagcaaatttagcccctaaattttcacttaaacgttgatattcattgttatattgctgtagaaaaacttgttgagaaatttcttcgccatttacttttgctacagatgtatctgtccgtataaacatataacctgctacgccactgagtacaaaagaaaccccgattaagccaaaaataattttagaaactataccgctagaggcattgttcaatttttccattaacattgaagaaatcctataaatgttagattaaaaagaaatgcgtaaaattataatcgaaagtaactcaattcgcacgattaaaataataattcatcaacaaaacactttattttatagattgaatgaattctgtggcagtgcataagatacggtatcttagaattatgataaaaatatttaactgagctaaagtagtttaaaagtgcggtgctaattcatgacttttacgagtcatacataaaaaaagagtggatttcccactcttttattaaaaaacaaagtcttatctttttatcattcaaccactaaagcacggcaagtagtcgtaccatttgatgttaagtggtctccttgagttaataaaaccaaatcaccggaaactaaataacctttatcttttagcgattgtatggctgcttttaatccttcaagcgtacgactatcctgatcaaaatgaattggaataacaccacgatacaatgcacataaatttaatgtactttcatttcgagaaagggcaaaaattggtagtccggaactaatgcgagacatcaattttgcagtatgaccactacttgtcattgcgatgatggctgcaacacctttcatatggttggctgcaaacatcgtagacatcgcaatagtttcttcaatcgtatcaaattctttatctaagcgatgccgagaaatatttacactaggcattttttcagcacctaaacaaactttagccattgctgaaacagtttctgaagggtattgacctgctgctgtttccgcagaaagcatgacagcatcagtgccatctaatacagcattggcaacatccatcacctcggcacgagttggcataggattgctaatcatagattccatcatttgtgttgcggtaatcactacacgatttagctgacgtgaacgacgaattaattttttctgtattccgactaattccggatcaccaatttcaacacccaaatcaccacgagcaaccataattacatcagaagctaaaataatatcgtccattgcctcatcatcaataacagtctccgctctttcaactttagccacaattttggcttttaaaccagcttgttgagctaattcacgagcataatttaaatcagcactggaacgagggaaagaaacagcaagataatcaacaccaatacgtgcagctaaaataatgtcttctttgtctttttctgtcagtgcgttagcagataacccaccacctaatttattgatacctttattatttgataatggaccgccaacaattacttctgtaaatactttagtattgtctgtcgataacacttttaactgaacacgtccgtcatccaataataaaatatcgcccggaacaacatcttgcggtaatgttttataatccagtcctactgcttcttgattaccttcacctttgggtaaatcagcatctaaagtaaaattatcaccaatatttaagaaaattttaccctctttaaaagtagatacccgaatttttggaccttgtaaatctcctaaaattgcaacagttttacctaactttttagcaatttcacgaactttttcagcacgagcaagatgatcttctggtgtaccatgagaaaaattcatacgaacaacatttgcaccggctacaataattttttctaaattattacctcgatctgtggatggtcccagtgtacatactatttttgttcttcttagtcttctagacattcgttactccgtttaattattttgaataatataagattattaatttagtaaaacccgctcattatatgcttaaaataaaattagatcgagatcacattttggaaaattcttattatagctggataatggaaatgaatattcagattttttctctttttcttttcatgactgttgataaagtaagacttttatatattctttaaaaactttgttaatcatcaaccgcaccaacacacaaaaaaagcagtgattgctcactgctttttcacggtcattgaatgaaacctaccaggtccagccaacccctacaccaccgccgaaatcaccggcagagtttctgctaccatgtaatttcagcattattttaccattatcgctcaaacgcgaataacctaatgccaccgcattgtttcctttataggtacccgcagataaagcaaggctcgatttgcccggcatcgttactgtaggcaatgcggcggcagcatgtgctccagcaaccccggctctcaagtctttattgaatatctcaattttattgtcgagatggttgaatttttggtcagtatgtgtctgcaatctctcgacatatcccttgttgaccacggcattcggcgatgagttcggtgttaaatcaggcacacggatttcaccttttgcaccgtcaatctcaactttctgaccttgtccgtttgtgaacgtcaatgcacttgatgtcaaagtagccttgttattaccttctttgagagtgatcccccccgaaccataatgtgcagactgattgtttttacctgtcactgtcaatccgttgccgtcaagacgggatttattcccctctgcggtttctttggtttcaaacgaggtcatatttttcaaggtatcggacaacttcacttccataccgctgtcagaagcagtcactttaatattgctggcagcggttgttgcactgttaaactcgccctcgcctttgatgatcaatttctcgcctaaatttttatggacaggcacgccgtcattgccctcaaaatttaagcccgcttgwcctaargctttcamrtcttgcaagtttgccccacggtgaacatcaacgctggaatcacctgacaacaacttattgactgcgtcatcttttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaacatctcgcccactttcgccgtcaccgctttagcctcagttttcactgcttcgcccgcatttttcacgttttcagcttgctcttttgctttatcggcatcaatayccaamccgctwgccacgttgcccagcactacaggtttatcggtttcaccaccggtattgaccagagaaagttgygtatctaccgcacttttatccgctttcggtgtaccgttatyytcaacgtcttcggctttatartayttaccrtcrttggctttgactaatctattgccttgattatctgtaaatacgaccgttcccgcctcgccattgcgtaaagcgttcgctttgtcgttggcatttttgccatttaaaccgtctttgccggttaagcctttcgccgccatcgattctttgccgtctgatgttttttcaaaacctgacaatccatctttaccgtccgcaaagaccattatcttcggttttggagcagtttcagaagaatttggattatcaatccatttcgcccctgtagctttgacaagctgtccaccattgatcgcatctttggagtcagtcgataacttgccatcagcaatattgcttacaaccatggcttttggctcagccttaatcacgacctcgctttgtttgtccttaatagacgaaacaacatctttgccatctttggtgtatttaccgcttgcatatgtcgcatcctctaagtcggttggcttgtagaatttaccatcttgacctttaaccactttttcatcgcccagataataatcaaatggtctatttgaattggctgatgagagtttttgatcaagttttttaacttccgtatccacatagtttttattggcgacacttgaaccgtcagccttatcatctaaatcagcaagaccggtaatcgcacctatatatttaccatcagcacctttaccaaaagccagcgtcgctatatctttctctttacctttattgtctttatctttggtaactttcaggctgatggcatcagttgagccatctttgcccttcacggtaaagccgtctttaccataaacagcatgggttttgtcgccattagttgcgtctttatcacccacggttaaacctttatcgttcaaggtcgcaatggttgttttaccgtctttatctttcaaggcgatttcatcaccgttgatatttaccgtattacctttgtcgttcttaaactcggcagacttcaagccttttaactcctcattgagtgaaatttctagcttgctcttagcactatccgccttcaccgcaatattgccatcggtgcctttgaaatcagcgactttagctttatctaagccttgacctacaatttccagtttttcgccgaggtttttatgcacaatgctgtcgctgtcattaccggcaaaatccaatcccgcttgtgcgacagcttttaagtcggcaacattcacggctttatgcgatgaatctttatcaagctcgcctgacacgagttttttcaccaactcacgttgtttaccttgtgcagctgaagcaatgccactgtctttaatatcatcaatacccaaaccggatttaaggttatcaatcgcaacaggtgcaactgttttgcctgcttcaggtttaccgcctagagtgatggatgtttttgtgtcatcatcatatttcacagccactttctccgcttcggagtgttgtgcggtgactttccctacaatagccttggcaaccgcagacaagtcttgaacattgacagcattnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttttaagcccagcccactcgcaagtcctttaatttgtttggtatttaacgtcaagccggttctgtcaaagacaaaggttccaccattggattcaatgacaacattagtttttggttttgtaccattcgctccttgtttgttaaattcaatgctagaagcgatttttttacctttgccagctccgatttctcgacctccaatagacttaatgcctttcaaatcagaattgagagcaatttctagcgtagaggaatctttcttcgctgtggtagtgatattttgatgtgttttagccgaacctgaacccaccttacctttaattttcaagctgtcattaacggtaaatttagagcctttattcccctcaacttcaaattttgttgcatagttcattaatttctctgccaccgctttggaggtaactgctctttcatcgtgttcggaaacattatccgctttattcaaagttaagattaatttagcattgtctccttctttttcgactttcgttttaatatccttttctttcatgcctctatcatctttcttggcttccgaactgtcgatcgtcaacaacttgtctaagttgaccagttgttctgtttgacctgcgtcatttcctttgaatttaagccctctttcgtccacatattttttattggcggcgtcatagttgtccgtcggatcggcaacaaacacaattttccgcttatgtcgcattgacccgactgacaatgcattggacttcgccagcgaacctgtccccaatacaatggcattatgtatctcatcatctgccgtgatattcgagcctaagatgatgttttcgtttccttcaacttcatttcttgaaccgattgaaatattctgtttaccggtgattttgttgtccgatcccattacgtaattttgttctttctcaataacgttattatcccccacggcaaatgagaagttgcctcgtaccgtgttttctctaccgataccgatcgaactcattccaagcacattggaatcttgacctattgatactgcacctgtattcaatgcgtttgctccgtaccccatggcaatagatccttcatttctcgatatcgcaccatgtcctacagataccgaaccatcccccaacgcttccgttgttggtgaatccgacactttcacggatttatcccctgtaccttttagataatctattaatgcttgtgcttgaactaattccgttgtgctttttttaccattttcaaggtttattttgccaataccgacattttttccaaagtcagcttgtttatcatcaatattcgagccatctacttttaaatacgccgtgcctaacttatcaactaagtcagtagtcttggtataatttttcaacgcgtccgcgactgcttttgaggtaacgacttttccgttgttttcctccactttatcagctttatttaatttcagcgtaagtgtacccgcactttgaggatcgctaccattagatggtgccaatgttaccgtgatgtctttttcaacagtcgcactatttgctccagtcgtatcgctactgctaacaggcgagctatcaatcgtcaatgttccgcctaattgtaatgtggtttgtgtcgacttgtcatcattgcctttaaaggtaacacctttattgaccgctgtaattaacccatcaatcgcatctttataggtcgtgtatttatcttttgaaacggtagaagttgtatctgtatctgtatcatctcccttaactttagtaaatgatggtgcggtaaagttaccagttttatcaacagaaagccctaatttaccgactaaatcgtgaagttgtttaccattaatcgcatcagttgaattctctgcaatctgtccaccggcgacatttgagattttaacgtttttatccttgtcagtttttccattcactggggtaaaagttaacgcatgtccatccacttttaactctgctgtgttcgtgctacttgatccatctgtgttactcgtattatttttaaacactaaagcgttgctgtcatctttaccaatcgactcaataccttttaagtccttattaagtgcaattgttaactcacttccactagcttttgtagtgatattttgatgttttttgttatctgtagctgtagcatttttagtttccgccccttttatagataaagtcccactgatattatcagtattaccctcatctgaagttaccataaatgcagaggctttgtttgctagcaaattatccacatattttttgttgacggcgtcataatcttgctctggatcgcctacaaatactattcttcttctatttctaggtgttccgactgataacgcattagataccgctacagattgatttcctaatactattgcattttcagtatcttcaccaacatttatacgtgagcctaataatatatttccagttccagagacttcattattagatcctaataatatattttcatctttttctattttattactagaaccaatagagatatttctttcaccacttatattattatttgatcccattacataagttgatgttgattttgaacctatctcattttcatctcctactacaaatgagaaattaccatttactttattatctttacctaaaccaattgaatttactcctaatacatttgagccttgtcctattgatatagaccctgaatttaatgcattggctccatatcctaaagctattgagccttcattttgtgattttgcatcgtatcctatagagatagagccttctccctctgcaattgtttttgaagaatcagagacttttacagatttatctccactgccttttagataatctattagtgcttgagcctgtactaattctgttttttcttcatcatcaagttttatttcactaattcccacattagatccaaattctttttgtttatcgccaatattttctccagtgattcttaaaaagtcttcttctaatgtttctgtagtagcgaaatcttttaatttatctgccaccgcttttgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatctcttgtctaaatattttttgttgacagcatagttatcataagtatttttcttagcactatctgacgtatcctcaggaatttcttctgtaattaatacctttttaaatgtaggattttcttttatgccgattaaaagctcttttttatttttttcatactgtgttctgatattattacttgaatattgagtttctgtttttagtgccttatcttcaacctttgtattcccagccttaatgattaatttatcgcctagataatgcgttctttgttcaccaccatctccactgccaaaaacaaagccactattaatcgctgttgtattttgagcgattgcnnnnnnnnnnnnnnnnnnnnnnnnnnnnnnnnnnnnnnnnnnnnnnnnnnnnnnnnnnnnnnnaaattccgattttttaaatcccgttttactagcgtcttcaacttccgcacccaatacattcaccgctaattttgaaaactcatcggcgacggcgtagagttggcttccgttgatagcgtcggtcgacgttgccgttaccgcacctgcggcgacgtgtttaatgatacgctcattatttgccttacctatgcttaaaacggattttttattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcgcttgtgagccttgccccaacgcaatagaatcccctgctgctgtttcaaccaccgcactttcgcctatggcgacaccgccctyggctttagattgggcttgataaccaataatmactgcgttttttgcaccattttcagcttttgtywywgcyccgataagyacgctgtttkytgcattttgggcattggcttkattaccaatcgcaactacatttgaattggcgaatttgtcagaaccattgccctcaaatccwatattaatattattccccaacgccacgatatctgtaccgctgttgattttggttttattaccgatagaggttgtccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgtgtaactatattatttgaacccaatacaaatgagttaggaatatcaacactgacatttgtccctatgacgatagcgttttgagcttttgagcttgcacctttaccaatcgctataccagcagtagctgttgcactcgcatctacacctatggctacagaattgcttcctttggcaccatcattgttataatttgaaccttgttgcataggattattcacagacaaataatgcaaagttcctacattttttacgcctttcatcgcttcttttaattgagcaaggataacaacgtcggtatctttcgtacccggtgcgacgttggtgatttttcttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcttagcattttgtcctataacaatagagttgtcagaatttgctaaagcacctacaccaattgccatcgaacctgatttttttgctctatcgctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttttctcgctttaagttttaaatattctcttttaattttaatatagtttttataatcctgttcttttgtgactaataactttaagtcatctaagcctttgacagagacatatttcacgccggaattaatattatcttcttctaacgtattgccatacaggatagcttcttctaaggctcttaattgagatacgttgaccgcatcagtatcgctcgcacccggtgaaacgtttacgatacgtctttccgcattcttgccccccactgacaaatagccgattctttctgatgaaggtattgatatggcatttttaggtgcccatccgccttgtgccatttcagtttgagtataatcagtttttgcattgacgcccaatgcgatggaatctgaaaaagaggcttccgcaccattaccaattgccattgcatttttaatggtaaaatctgattttccattttgcttatttttttcacttcgaagtgcggttggcatttcagctaaaacttttgcttttatacctaatgccatagaatcatcagcttctactaatgaatgagtaccaaaagcaactgattgtttacctaatgctcttgtgaaatttcctattgaaaatgaagattctttttgtgcaaacgcaaatctaccgagtgcaacagtactatcttctttcgcataggcatatctacctaatgagattgcattatcccccaatgcaacagaataagaacctatggcaatagcaccttgattatgtcttccctacctatctttagattgctctgctttttcttcgcccgttccttcttggacggttgtgtgggcattaatatgttctttcattatatcttgtatcgctgctgtatcaccgatacgatataaatcttcgatggttattttgttattttgtaatccttgtggaccgccatcagcgtattcagggtaattttgtttatcttttgctaataagttatatggttcaataccaagcccctcaccattaaataccttacccatcttcacattggcaaaggtgtgatcaccaatcgctaacgatcctaagccccctgcaaaagagtctttaccatataccatagatccggtaccgatggcttgtactttattcccgataccaacagatccgtctgcatagacatagctgttattacccatcaccaatgaaccttcaccaaaggcgacggtgtttgagccgatagcggttgaataatctttagccgctacagcaaatgtccctaaagcggttgaattatctccataggcaattgaacgtgccccaatagcaatggcgttatttcctcttgcccaagtatgtgttttggtatttctatgatctgctaaatatttttgataagcctctccttctttttttagatagagttcatatcttttatagtctgataatgcctttatttgttttattttttcttcatatcctggggtgttaggatcgatataatttttatatgcggcgttttctgattcaacatcataaaaattttccccctctatgcggtaatatccacctttatagtctttaccattttttctcacaaaatatgtgccgttttgatatattggtgtgtaaccatcttcagctaataactgtccttgatcattaagcataggcttaccgctatcatctttcataatctcaaaatcaacggcagcatattctttggtatagttaaaatcatttcttacattataaaaaagtctaaacatctctttagaaagcggtttggcatcatgccctgcggcattatcgctcccgatagaaatagaggaatctccccatgccaccacatcgttacccaaagcggtcgcttcttggcctcgtgcaaaagatcgataaccgacagccgtaccttctttatttaaagctcttttaggatcttttttgcgtttctctttctccattattatcacttggttaataatgtctcgttttttttcttctgttgtaggtttccacttaggattagtggcaaattcaaaatacttttctcgtaagtctttatacgaaccatcttcgtctttgagcagaatagattttgcttcttcttgcgtaacggttggattgtgagctgaagtcgctgtattttctccggtagcggctccaaaaccgatagcggttcctttatcaccgcccacgactgctcgagaccctatcacaacagtttgattaaagtctttattgctatacgaagcattttttcctgttttattagcataatccgagaggataaccgcttcatcgggaatatcagattgtttatatggtcgattccaagagctatacataatttgcgttttacggtttagggtgcttatcgtttgtccatctgcaacatcagcactatgaacccaaacatcatacccatacgccgctctcgataacagcccactcatcaccaacgccaacggcagaaccttaaacgcccctaacataccgccgaaaaacacaccgcacttcggctgacttcccgccgcctcaacacggctcgccacctgacggttattcgctaattcagacactactttagtttgaccggttgttacatcgtatttkgttttgaagattttgttcataaattcactctctttaagcttttaaaattaggttttttaataatgtatgttgtcgattttttaacttttacggttgtttattgattaaacgtkttrctttttagatagattgataaataaatcggcgatgccttgctttttaagacacagcagaaaaaggcgaataatactttcgccgaaaggttgaggttgaaataggtgatttttatttttaagacgttgtttgaacatgtccaacctctcaaaattaacttgaaaggttgattttagccaatatactaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtcattttttctgttctattttatttgtcaagtaataattcggattattctatctcaaaattgttatgggaaaaacgattttttatttttttattcacttttttgtttgttatcagctaaaagatatttttttgcggcggctaaatattgaaacattgaccaaactgtcaacatggcggcgatatacaaaaagacaatcgctgtaatttccattaatgtattgtagtgccataaaagaccgccaagtgcaagcatttgtgaggctgttttaattttccccagccaagaaaccgcaacgatgccacggctaccgatttctgccatccattctcgtaatgctgaaatcacaatttcacgaaagatcataataattgcaggtatcgttacccaaaaaacatgttgatattcaacaacgagcgtaagtgccgcaatgaccatgactttatcggcgacaggatctaaaaacgcaccaaaaggcgtactttgattccatcggcgagcaaggtaaccgtccagccagtctgttattgaggcaatgaaaaaaataatagttgtgagaaaaggtgcccaatgaaaaggcaaataaaatgttacgataaagaacgggattaatccgactcgaaataaagttaagattgtaggaatattgaatttcataatgctgttttgagtagagtagggatacgctgtattctaaagtatatcccttatttttaaaagcctgatgaaactaacaaagtgaaataattagttgtttttgatatgggattttaacgtttgttcaatttcataaatccaatcgagttcatattgagtaaaaccggcttggatacgagcatcagtattaataactcctttaaaaatcacgatgcgatatttacgtaataattcgctaaaacatttcattgcatctaattgacgtttagcggaaagtgcgtgataccaatgattcccaatagaaacatgaccaatttcgtcacgcaaaataatatctaaaattgccactgcctcgacgtctttacgctgtgcaattttttcttgtagtattgggtttgcatctaatcctctggcttccaaaactctaggtaccaatgccatacgctcccaaatgtcatgagccgtcgcttgagccatttcccataagccggcatgtgcttcaaaatcaccgtattgatatcctaatgtgtttaaatgctcattcacgagagtaaagtgagtgctttcttcacgtgcaactttgagccaatcttgtatgaacggcatgccttgttcgagttcctcttgtgcgtgacgtccaaatctccacgcagcatctaaaccaaggtttattgcattaaattcaatatgagcaatggcatgtaatgttgccgcataaccttcgtttgtggcaaaagaacgtttcggcacattttggggagcgacaaggaagggtttgtgtggaataccgacaatttcttgttcaggtgtaacaagaggaaaatcgtccgtttgatctagatttatcgtaggcaaaatttcatcatataactgattcactaaacgacatttttcatagggatttgtttctgccagtgcggttgttattttatgccaaaagtcttgagttgaaagtgcggtcatatttttccttatttcatagaataatttttaatcgctcaaagtatagttatcagagaaagatttgcaatcggaatttgcttataggataatgcaccccattagccgttcggttaattctatggaaatcttttcggttcctcgcaatagtgtccgatttactcggtcaggttcggaagaaagcagccaaagtcggaatttctgtgtgccgagatcctgccggaaaggtttccgcccatctactacatttcaatatgtataaaaaaagcaacttttcagttgcctttattcaatttagctttgttcttttactgcctctaatgcacgcaaggcataagtataagccgcaccggcgttcagtgcaatcgcagtagccaatgctccggcaatttcactttctgttgcccctgctttagctgctttttcagcatgaacactaatacaactttcacaacgtgtcgtaatagcgacagcaattgcgataagttcacgagttttttcatcaagtgcttcagccgcagcagcctgatctaagttaatataggcttgtaacattttcggatgagacttgcccaattcgccaaaagattttttaacatgagcggtatgctctttccaatctgtaaatgttgtcataagaatttcctcttgttgttaatcaagttaatgttgataattaaccgcacttttataacttgattgactaaaagtgcggtgtaatttgaacatattttttagatttaaattcgttcaataagttgtttaaaaaatcctttttcttgttgaatcagttgatggtaatgtccttgttcaactagatggctgttatccatgatacaaagtaaatcgaattgttcaagtgctgttagacgatgagtaaccataatgaacgttttattttgacaatgttcaaataatagcgttagaacatggcgttcagtatctcgatccagtccttctgtcggttcatcaagtagaataatgggggcattattcagtaaaactcttgccagtcctaagcgacgctgttcaccgcctgataaaggtcgcccgccgtcgcctaaccataaatccagtccttgatcctgctgaactaatttttccagacctaccttttgtagtatatgacacattttttcatcgctgatttgttggctacctgctatttgtaaattattgcgtaaagtatcactaaaaatatgtactcgttgagtgagtaaacagatattttggcgtagcgtttcttcggtataaacttgaatcggtgcattagagagtaaaatttccccttggttgcaatcatagtttcgaaccaataattgcagtaaacttgatttgccactccccgttttcccgagaacagccactttttttccagcttcaacggttaaattaatttgttgcaatgcctgatcattgcgatccggataagaaaaactgacatttttcagttgaataagcggatattcattgttttgcaatatgtgagtaccgttgaattgcactaaaggtcgttgtgcaagaagttcattaatgcgttctgcagatgaaatgacttgtccaatatgtaagaatgcggcactaataggcatgagaagctcaaatgaggcaagagcggcaaacgcaaataacgcaataaaagcattgtgataatctgcaatggaaaattgtgctttcgccgcaaaccaaagggttattacaaccagtaatccgttaataaatacgacaagtgcggtagataatccgactaaatttgtttcttgttgttggtaagattgccattctaattcgattgcttttagtttctcttttgagccaaaggctgcattaaagagtaatagttccgcttgcgactgaataaattcgataaaataagtgcgataaactgaacgagattgagttaatttagcaccgaatttacgtcccagccgataaaaaatgatgggaataattaaaagtagcaacagcaggcttataccaataaatacgccgatagaaacattaaataaacttaagcctaacgtaataaaagcaataacaatcattgcactgataaaaggggcaataaggcgtaaatacaatgtatctaaagtatctacatcagccactaaacgattaagtaaatcactgttgcgatagcgattaagtactgcggggcttaaaggaataagtttactgaatacttgaacacgtaattttgccaatacacggaaagtggcatcatgcgtcactattttttcaaaataacgtgttacagttcgaccgattgctaaacctctgacacttgccgacgggtagaaaaaattaaataatgtgccaataccggctaacgccgtggcggcgagaaaccagccagatagggttaataaaccgatgcttgaggctaatcccgcaatcattaatattccccctaaaatgagagtaaatttagcgtgataaaataagcgaagaaaaggaagtaaagctcgcattattgaatttcctgtttttgttgagccaaaagttcggcgaagaaaccttgttcttttaattgttcaaaacggccttgttgcacaatttgcccttgttgcatcactaaaatttggtcgcattgttttagatcttcaatgcgatgcgtaatcattaaagtagtttggttacggctaattttttgtaacacttgtagtacggcattttccgattttgcatcaagacttgcagtaggttcatcaagtaataataaattgctttgacgcaataatgagcgagcaataacaagacgttgtgcttgtccgacggataaaccaataccgccttctctaatcagaaaatcaagtcctaatttcgcacaaaaagacgaggcttgtgcttgttctaatgcttgcgtaatttgttcgtctgttgcttgaatatcaccaaaaagtaaattttctcgaatcgtgccttgtaataataaaggattttgccctacccaagcgatattttttcgccattcgtttaaagataaatcatgcaattcaataccattaatttttaaacttccctgataatttaagaaaccgagtaacacgttgattaatgttgttttacctgcaccgctttgcccaactaacgcagtattgctttgagcagtcaagcaaaaatttaacggagcggttaaaggatggccttgtggtgaaagtgcgatgagatttttcgctataatttcgaccgcacttttaggctcgatactatgtgtttgttcatattgttgagaagtaacttcttgctccaaaaatttaacgatttcatcagctgcaccaatacctgctgcacgatcatggtaataagcacccagatctcgtaaaggttggtaaaactcaggagcaagaattaagcagaaaaagccaataaataaagtaagttcagtgtcgtaagaaccgaagttaatttgtcctaaataactaaaaccaaaataaactgccattaatgcaatagagatagaagtaaaaaattctaatactgcggaagataaaaatgccatttttagcacagtcatagttgtttcacgaaaatcttcagtgctttcttcaatatattcagtttgctcttttgttttattaaaaaggcgtaatgtttctaatccacgtaaacgatctaaaaattgaccgctaagttttgctaaggcggacatatttttttgactactatctgcggcggctaatccggctaaaatcataaaaataggaataagcggagcagtaagtgccaagattaatcctgccgcccaattgagtggaaagacagcgattaagataatgattggtgtaatggctgaaagtgcttgttgaggtagaaagcgagcataaaaattgtgcagattttctacttgttccagcatcaaggttgcccaacttcccgcagatttttggttgatcattgccgggccagcttgatgaattttggcgaaaatttgttgacgaatatgatgacgtaattgttgaccgcatttaaagcccactttttcccttgcccataatattaaaccacgtagcataaaaccaagaataagtgctagaaagtgcggtattaattcacttcgatccgtatttaaaataatgagttgatgaagcaggtagcttaaaatataagtttgtgcaactaaaacaacggatgaaatagttgcaagaataatattaagcgaaagcaactttttgattggcttttgttgtttgcgtagccatttgaaaacatacttttgacgtgatttttccattgttactgctagaggttatgatatatttgtggggcaaattagttgccccaatatgactgagttaattatttttgtgtatccaaaaaacgttctgcatctaaagctgccatacatccagttccggcagatgtaattgcttgacgatagttgtgatccattacatctccggctgcaaaaactccttggacagatgttgccgttgcattaccgtccaaaccggattttacgacaatataaccgttgtttaattcaagttgattggtaaacaattcagtgttaggagcatgaccgatcgcaataaataccccttctaatttaagatcttcaacattttctgtttgtgtgtgttttaaacggattccggttacgcccatattatcacctaaaacctccgctaaagtgcggttcgtatgcaggataatttttccttcttccacttttttattgaggcgatcgattaagattttttctgcacgaaaagtctcacggcgatgaattaaatgaacctcagaggcaatatttgcaagatataaggcttcttcaacagccgtattaccgccaccaaccacagccacaggtttattgcgataaaagaagccgtcgcaagttgcacaagcggaaacacctcgtcctttgtaagtttcttctgaaggtaagcctaaataacgagccgatgcacctgttgcgataatgagtgcatcgcaactgtaagcccctgcatcaccaaatagtttgaatggacgttcagataaatcgacattattaatatgatcgaagacgatttcggtatcaaatttttcagcatgttgcaacattcgttgcattaattccggacctgttgtatcaccaaagtctcccggccagttttctatttcagtcgtcgtggttaattgtccaccttgttgtaatccggtaaccaatacgggttttaagtttgctcttgccgcataaattgcggcagtatagccggcaggaccggatcctaaaatgagtagttggctatgtttaaaatctgacataaaaatccttgttagtaaaatcttgcaagattgtgggttcgcttattatagagatttcaataattaaatctatcattaaatagaaaaccatagtggctattatgttgctagaggcactatttttaacattaatatttgactgtgtgtccataattttcaatgatagatttgatatgttccagtgaatctttagttggagggactacatcttccagttcatattgttcgcccatcgttttccatttatgtgcacctagctgatgatagggtagaagttcgacctgttcgatattgctcatattttgaataaattgacctaataagtgtatatcttcatcagcatcagtataaccgggaacaactacatagcgaatccaagttttttgattgcgtttttgtaagtatttggcaaattctagtgtacgcttgttcggtacaccgataagattttggtgcactttatcattgagctgttttaaatcaagtaaaacaagatcggtaacatctaataattcatcaatgacatgatcataatgacgtacaaagccatttgtatccaagcaagtacttattccttctgctttacaggctttaaaccaatctcgaacaaattcagcttgtaagatagcttctccaccggatgcagttacgccaccgcccgttgcattcataaaatgacgatacgtgaccacttctttcattaaatcttctacactgatttctttgccatcatgtagatcccatgtatctcgattatggcaatatttacaacgcattaagcagccttgcaagaataaaatgaaacgaatacccggtccatcaacagttccacaagattcataagaatgataacgtgcgagtacagacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatattatgtttgtgggagccgatggtgttgatgccaaaataggactgacaacctttaatgagggctacaatatcagttcaattatggcagatatttccgccaaagtagtagctgttgttgatgcaacaaaattcaaccgtaacggctttaaccttgtacttccaatgcaaaaattggatttagtcattacagataatagtctgacaaaggaaaaacagctggaattaatttcggtgggtgtaccgttacagttagcctagtaatcagcaaaggcggtcatatttttactaaggtttgtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagataaaaaacggcggtaattatatcatgcactattaatttgtaacttattctttggattgttcgggaataatgacatccaattcgatccatttgtaccaaatttgttgtaaaaattttagtatgttctcatcaattgcaagagtttttaaagactcttttagttcttgtagtgagtaagctttttcttgtaacagcattaataaaaaatgatctaagtccgttaacttttggtaatacacctcaaattgagcattacgccaaacaattgtttttgatggttgattcagtatttggttaaactgagttgaaagaaaatccaccggatattcttttataaagcaaacctctgagcatttcattggggtttgttcagttatatcgaatttagtcggtagctgaaacattgatacttccgcttgaagttgatcaaattcaaattgcattagggagagaatattttcatcgaaaatatttttgtgttggcaaaattgtaaaaactcacctgcaatatcttggaagtaaggggaatgtgcttttccgtttttgataaattcttcttttgcattatcccaatcttgtcggtttaaatgagccggagtttcggtaaagcatttttcgataaagccaaaagtattgttgcgtaataaccgcacataaatatttaaacgtctaggatcgtgattgctagggtctttttcacgaatagcttgaacaaattcttgttgcgtttgtgctagatttttaaccatgacaatcctctttttttgacatatttttgttgtagttgatggataatatcgacttctttacaaagtttttcaaaaggggggaaattgaaatcacgttcaagtagtgttggtggcatatgaggtaaacgtgcataagtatattccagtaaatcccaaacggtaccttttacattttcaccatgtgtatcaacaagtaattgaggaagatggcgaaaatctcctttgattgtattgaaagcctctgatgtttgtatttggacttcagtagcagaatgctcttcatcatgcccagcaatatgaatataattgacacgttttagatccacattatcaatgaatatatgaggatcaagtaagttatgattgaccgcatttacatagatattattgacatctaaatgaatgccacaatttgcctcttgtgcaatagcattgagaaattctacttcattcatcgtgcttgtttcagaatgcaaataataagaggtgttttctactgaaatttgaatttctaaaaaatcttgtacttcacgaattcttactgcagtgtgttttactgcttcatcagtaaacggcattggcaataaatcatataaatgaccatcgcattcgcaaaagctcagatgatcggaaaagaaaggcgtattatattgttttatcatggctttaatgcctgataacaattctttatctaaaggggcttgtccaccaagagaaagagataacccatggattagcatagggattttttctgccactttatcgaattgataacgcgcaaatcctcccatttttaaccagttttccggtgctatttccataaattgaattcgatcattattgcgtaactgtagaaatccttccgctagatcacgtctgtagcctaaaccggcaccttgtcgcatatatcctccgtgtaaataaaaagggtgcgatgcaccctcaaaaatttatttagatgcaccgcactttccttcgccacatttgccttcggcagatttcggcatatttttcttaggagcggttgcaccgcattttccttcaccgcatttgccttcggcagattttgatacacatttgccatcgtgcatttcacactcggttgtgttttttttcatatctgcatgtgctgatacagccatagctaaggcaccggctaaagcgactaaagttgtttttttcatggtttttctcctatataaatgattaaagtaaattcagccgtttttgagctgagtattttttccgtaacagaaaatcaagtgaaactacacccgcaccttgtaggagcagaggaagtaacgtaattatgtaaatgagcggtaatttataaccattgttgcatacgttataacctaatccgctatgtactgttgcccaagctacagcggttaaaatcatcaaccctaaagcactaaagcgagttgcaatacctaaaaccaacaaaatcggaaacaataattctgcaccggttgcaatagcccaatttaagtccagtggtaaaattgagaaaggaaacggaaaattgtcttttaccgcataaaaccaattttcaccgttccatttttctagtcctgcttcgaaaaactcataggcgacaaaaaaacgtaatacgagtaaggataatccctgagtggattgtttaaaaatatgacaatgagacattttctactcctaaaaaattgctttctagaagttagacgaatgagaaaataaaaccttacaaaaaaatttcaaaaatttagaaaaataaaaaggtcagattttactctgaccttttaaatattctgatttaaaacttacattgacgttgtgaatgtacgtgtaattacatcttgttgttgctctttagttaaagagttgaaacgtactgcgtaacctgatacacgaatggttaattgcgggtatttgtctggattttctaccgcatctaataacatttctcgatttagtacattcacgtttaagtgttgaccgccttcaatagttgtttcatgatggaaatatccatccattaaacctgccaaattgcgtttttgtgcatcaatatctttacctaatgcattaggtacgatagagaacgtataagaaataccgtctttagcataagcaaatggaagtttagcaacagaagttaatgatgctaccgcacctttttgatcacgtccgtgcattgggtttgctcccggtccaaatggtgcacctgaacgacgaccatcaggtgtgttacctgttttcttgccatataccacatttgaagtaatcgttaaaacagattgagttggtgttgcattgcggtaagttttgagtttttgaattttcttcatgaaacgttcaaccaagtcaaccgcaatatcatctactcgtgaatcgttgttaccaaattgtggatattcaccttcaatttcaaagtcaatcgcaacattttttgaaataccgatcacgtcgccagctttatttttcacttcaatatcaccacgaatcggttttactttagcgtatttaattgcagaaagtgagtcggcggcaacagaaagaccggcaataccgcaagccattgttctgaatacatcacgatcatgcaatgccattaatgccgcttcataagcatacttatcgtgcataaaatgaatgatgtttaatgcagtaacgtattgttttgctaaccagtccatgaagctgtctaagcgagtcatgacatcttcataatctaaatattcagttgtaataggatcggttttagggcccacttggtcaccggatttttcatcaataccgccgttgattgcatacagtaatgtttttgctaagttcgcacgagccccgaagaattgcatcattttacccacgatcattgggcttacgcagcaggcgattgcatagtcatcattttggaaatccggacgcattaggtcgtcattttcgtactgtacagatgaagtatcaattgatactttcgcagcatagcgtttgaaaccatcaggtaaactttcagaccaaagaatagttaagttcggttctggtgaaggtcccattgtgtaaagtgtatgcaagatacggaaacttgttttggtgactaaagtacgaccatctaaccccataccggctaaagtttcagttgcccacattggatcaccggagaataattgatcgtattcaggcgtgcgtaagaagcgaaccatacgaagtttcatgaccaagtggtcaattaattcttgagcttcttgttctgtaattttgcctgctttgagatcacgttcaatgaaaatatctaagaatgtggatacacgaccaaaagacattgccgcaccgttttgtgatttaacggcagcaaggtaagcgaagtaagtccattgaaccgcctcttgagcattttttgctggagcggaaatatcatagccgtaagatgctgccatttctttcattttgcctaaagcacggtgctgttcagcgatttcctcacgtaattgaatcgttgcttgaatatcttcaccgctctctaatttctcttgtaatgaagtaaattgtttgaatttatctttcattaagaaatctgcaccataaagtgccatacggcgatagtcaccgatgatacgaccacgaccgtaagcatcaggtaaacctgtgattacacctgatttacgacaacgtaaaatatctggtgtataaacatcgaatacgccttgattgtgagttttgcgatattcagtaaagattttttcaacttctggattgagttcacgacggtaaactttacatgagcctctaaccatgttgattccaccaaacggcataattgcacgttttaagggagcgtctgtttgtaaaccgacaattttttctaaatctttattgatatagcccgctttatgagaagtaatagtggatggaatatctgtgtcaatatcataaggttcgtgagttttgttctccactttgattttttccattacatcagcccacaggattgatgttgcttctgttgcttccgctaagaatgcttcatccccctcatacggagtatagtttttttggataaaatcacgaacattgacttcagtttgccaatctccaccgacaaaaccttcccaagctttttgttgagtttctgttaattgagccatcgctaataacttccttttgagtaaataaaaataaaactgttgaactttgtaaaaacaatcgaaaaacagaccgctcttacaccctaatgatttattagtgtctatgaggtttattggtaaaccattgcattaatgcaatacaaacaccgccaccgataatattccctaaggtgacaggaattaaattcttaaagataaaatggtaaatatccaaatcggcaaattgcagaggattaagattaattgcttgccaaaaatctgttgagctggcatgtgaggtaattattcccattgggatcataaacatatttgcaacactatgctcaaagcctgaggcaacaaatagacctataggcaaaatcatgatgaatgctttatctgttaatgtttttccggcataactcatccaaacagcaatacataccataatgttacatagaatacctaagcaaaatgcttcaagccatgtgtggtgaattttatgttgtgctgtttttagaatggttaaaccccattgtccatttgctgccatagtttgaccggcaaaccaaattagcaatacgataattaatgaaccgacgaaattacccaaataaacaacaagccaattttttagcatttgagttgtggtaattcgtttattcacacgtgcaataagagacatagttgatgatgtgaaaagctctgaaccgcatactaccgccataataataccaagagagaaaaccaaacctccaacaagtttggtaagtccccaaggggcattacccgaacctgtctgagtagtagtgtaaaaaacgaaagcaagggcaataaatgcacccgcagaaattgcagataagaatgagtagaattgatttttagttgctttataaacacctacattctcacctatttgtgccatttcgctaggtgatactattatggttgtattttcggttttcattacaaaccctattgaaattaaactggcgttattctaagtcattaaccggaaactttaaactaaaaaattttttattttttataaaatttgttaaatgaaattatttttaacaagtttttaacatttagttgttttacatttattaaatgcaacaatttattaacattagcaatctaaattgctatttaaagggatttctgatacaaaatgcacctattatttttatatcatgggagaacaaaaatggtagaagaaactatttttagcaaaattattcgtaaagaaattccggcaaatattgtttatcaggatgaattggttactgcatttcgtgatatatccccacaagcacctacccatattttaattattccaaataaaattattccgacagttaatgatgtaacatcagaagatgaagtaacgttgggacgtttatttaccgtagcggcgaaacttgctgaaaaagagggaatagcacaagacggttatcgtttaatcgtcaactgtaataagcatggaggacaagaggtttatcacttgcatatgcacttggttggcggtgagcatttaggcaaaatgttggcaaaataatgaaaaatttacttatcgcttttattttgagtttgggattaattgcttgtggttctttggaaaaagtaaatttagtgcattctcaacaaccaattataaatattagtaccgagcttgcttctgatattgacgtacaagtcagccattcatcagcatcgctgacaaacgtttcacaaaagcaagtgacgctcgtatattattttttttggtacgataaaaatggtgtaacacaaggtgatgtgactaatatgaaaaatgccactatgctgattttatcgccaggtcaaacacgtcagttagtattacaaaagccgacaacagaaagtgtgaattaccgcctttacttgagtttatagaacaaaatgtcgatattattaatagatttatcgggtcaagagttacgtcaagaagaaatcgaattacttgaacatcctctagtcgcaggattaattttatttagccgcaatttttatgatattgagcaaatccgacatctcattagatctgtgcgtcaaaaggttaaaaagcctttattaattactgttgatcaagagggtgggcgagtacagcgttttcgtcagggtcttacgcaattaccggcaatgcagtcctttgcctgtttactttctgaccctcaagagcaacaggaaatggcttggcgagcaggttggcaaatggcggcggaaatgaccgcacttgatatcgatcttagctttgcacctgttttggatcttgggcatcaatgtaaggcaatcggcgaccgcagttttcattatgaggaaaagaaactgattgaacttgctgagaaatttattcaagggatgagacaaatcggaatgtcggcaacgggtaagcattttcccggtcatggacatgtgttagccgattctcatttggaaacaccttatgatgatcgagcaaaagaattaatttttgcacaagatattcgaccgtttcagtctttgattaaacaagggttgttagatgcagtgatgccggcacatgttatctacactcaatgtgataatcaaccagcaagtggatcgtcttattggctaaaggaggttttacgtcaacaattgggattccaaggagcgattttttctgatgatttgggtatgaaaggtgccggttttatgggggattttgttgctcgttgtacgcaatctcttcaggcgggttgtgatttattgttgttatgtaacgagcctgaagcagtggtgcaagttttagatcgttttaaaccacaggaaagtcaaaataaacgaataatacgccaaactagattgaataaattattcaaaaaacaacggattgattggcaaaccttacgcactcaacgtgattggttggaaaatcacaaaaaacttaccgcacttcagcaagattggttagcctataaggggtaggacaattagaaattatggaggtggttttttgagagtatacaaaaataaagaagaactcaaaactgaaataaataaagcatttaagaagtatattttagaatttgataatattccagaaaccttaaaagataagagagttgataaagttgatagaactccagctgaaaatcttgcttatcaagtgggatggacaagtttggttcttaaatgggaaaaagatgaaagaaaggggcttcaagtaaaaacaccatcggatgaatttaagtggaatcaacttggtcaattatatcagtggttcacggatacttatgctcatttatccttgcaagagttaaaagcaaaattaaatgaaaatattaatgctatatgtacaatgattgattcgttgagcgaggaagaattatttgaaccgcatatgagaaagtgggctgatgaagcgactaaaacagcgacttgggaagtgtataagtttattcatgtcaatacggttgcaccttttgggacttttagaacaaaagtcagaaaatggaagaagacagcattataaattacctttttacaaaaaaatttcataaaaatagttaccaaaggcaatagagaaaactatcgtctttctctttgcaaatttaaattttattaaattaatatgaatttaattcatgaaaagtataatttttctgaaattgacacatattttctttctctttatgatgattttaaccgatttaaagataaatttattatggagtaaatgaatatgagttataccaaagaattagatacattaaatcaccatatggttgatattaatgggaaaattaatgtttcttttgagttttttccacctaaaaatgaaaaaatggaaactcttttgtgggactctattcatcgtttaaaagtccttaagccgaaatttgtatcagtaacctatggagcaaattccggtgagcgggatcgtactcataccgttgttaagcgtattaaacaagaaaccggtctggaagcagcaccgcatttaaccggtattgatgccactccggaagaattaaaggctattgctaaggattattgggatgggggtattcgtcgaattgttgctttacggggtgacgaacctaaaggttatattaagaaacctttttatgcctccgatttagttgagttattacgttcggtagctgactttgatatttcagtggcggcttatcctgaagtgcatcccgaagcaaaatccgctcaagcggatttaattaatttaaagcgaaaaatagatgcaggagcaaatcatgtaatcactcaattcttttttgatgttgatagttacttacgttttcgtgatcgttgtgcctcaatagggattgatgcggaaattgtaccgggcattttaccggtaacgaattttaaacaattacaaaaaatggctgcgattacaaatgtcaaaattcctagttggatggcgaaaatgtatgaagggttagatgatgatcaaactacaagaaatttagttgcggcaagtattgcgatggatatggtgaaggttttatcttgtgagggggtaaaagatttccatttctatacactcaatcgcagtgagttaagttatgctatttgccatactttaggcgttcgcccaagtttataaaaaaccgcactttgagcctaaaaaaggactaaattgttaaaatttggtccttttatttttacggattttattaagaaatgcacaatttaaaatggaatgtcatcatcaagtggagcatcaacaggtgatggagatgcaatgctcggtttaggtcgagaatgtgattggtaggttggttgctgttgaggttcgtatcctcccatttgtccacgatctgaacgactatcyarcatytgyaatacatcgccytgaatttcagtggtataacgatcttgmccrttttgatcttgccatttrcgkgttyttaracgtccttcwacataractttygagcctttgcgtaaatattctccagccacttctgcttgacgacgataaaacacratscgatgccattcygtwawttcacggcgttcattggtatttttatcaatccaactttcacttgttgcaacactgatattcgcaacagcatcaccgtttggcatggtgcgaatttcaggagcgttaccaagatttccaacaatgattactttatttactccagccataagtcctctaatttgcttcagttaaaaagtgcggttattttgccttaaattaaaaaaaaaagctatgcttaaaatgaactaaactggatatttgcacagttgtttaggaatgtgagataatgatcgcaaaatttacttgattggcttgctattattgtcaatttattgttggtgtattatggaaaaaattgatattcgtggggcaagaactcacaatctaaaaaatataagtttaacaattcctcgtaacaaacttgttgtaattacggggctgtctggttcaggaaagtcttctttggcttttgatacgttatatgcagaggggcaacgccgttatgtagagtcattgtctgcctacgctcgccaatttttatctttaatggaaaaacccgatgttgatcatattgaaggattatctccggctatttctattgaacaaaaatccacttctcataatcctcgctcaacagtgggaacgattactgaaattcatgattatttgcgtttattgtttgctcgagtaggtgagccgagatgcccagaacatcatgttacattaagcgtgcaaactattagccaaatggttgataaagtgctgagtttgccggaagaaagtaagatgatgttacttgcaccggtggtcaaaaatcgtaaaggcgagcatatcaaaattttagaaaatattgccgcacaaggctatattcgggcaaggattgatggtgaaatttgtgatttatcggatccgcctaaattagaattacagaaaaaacatacaattgaagtggtggttgatcgctttaaagtgcggtctgatttggctactcgtttggctgaatcttttgaaacagcgttagagttgtccggtgggacagcaatcgttgcggatatggagaattcgcaagtggaagaattgattttttccgctaattttgcttgccctcattgtggttattctatccctgaattagagccgaggttgttttcttttaataatcctgccggtgcttgttctacttgtgacggtttaggcgtgcaacaatattttgatgaaaaacgtgttgtacaaaacgcatcgatttctttagccggcggtgcgataaaagggtgggatcggcgtaatttttattattaccaaatgttgatgtctttagctaagcactatgattttgatattgaactaccttttgaaaagttaccgaaaaaaattcagcaaattatcttaaacggttcaggtaacgaggaaattgaatttcaatatatgaacgatcgtggtgatgttgttcttcgccatcatagttttgaggggattctcaataatatggctcgccgttataaagaaaccgaatctatgtctgtacgagaggaattgtccaaaaatattagtagtcgaccttgtgtagattgttgcggttcgagattacgttcggaagctcgccatgtttatatcggtgaagctaatttacctgatgtatcagagaaaagtatcggagaagcactcaattttattgataacctgacattgacgggacaacgtggacaaattgcagacaaaattctgaaagagattaaagagcggttacaatttttagtgaatgtggggctgagttatttatctttatctcgttcagcggaaactttatccggtggagaagcacagcgtattcgtttggcaagtcaaattggtgcaggattagttggagtaatgtatgtacttgatgaaccctcaatcggtttacaccaacgagataatgagcgtttattaaatactttgttgcatttgcgtaatctaggcaacacagtgattgtggttgaacatgatgaagatgctatcatggcagctgatcatattattgatattggtcccggagccggtgtgcatggaggaaatgttgttgcacaaggtaatgcacaagaaattatggctaatccaaattctttaacaggtaacttcttgtcaggtaaggaaaaaattgaaattccgctgaaacgaaccgcagttgataagcaaaaaatgcttagattaaaaggagcaagcggtaataacctgaaacaggtgaatttggatattcccgttggtttatttacctgtgtaacaggtgtatccggttcgggaaaatctaccttaatcaatgatactttatttccattggctcaaaatgcgttaaatcgtgcggaaaattcccagtttgcaccttatcaatcaattgagggacttgagttttttgacaaagtgatcgatatagatcaaagtccgataggtagaacgcctcgttccaatcctgcaacctatacagggttatttacgccaattcgtgagttattttccggcgtgccggaggctcgagcgagaggttataatccggggagattcagttttaatgtgcgtggcggacgttgtgaagcctgtcaaggtgatggtgttatcaaggttgaaatgcactttttacctgatgtttatgtgccttgtgatcaatgtaaaggcaagcgttataatcgagaaaccttggaaattcgttacaaaggcaaaactatccatcaagtgcttgatatgacagtagaagaagcacgagtgttttttgatgctattccaatggtagctcgtaaattacaaacgttgattgacgttggtttatcttatattcgcttaggtcaatcttcgacaaccttgtccggcggagaggcacaaagagttaaattagcaacagagctttctaaacgagatacagggaagacgttatacattttagatgaaccgactacaggattacattttgccgatattaaacaactcctgaccgtcttacattgtttacgtgataagggaaataccatagtggtaattgaacataatctcgatgtaataaaaaccgctgactggatcgttgatttaggaccggaagggggaaatggcggagggcaaattattgctaccggcacgccggaagaggtttgcctagttgaaggatctcatacggcgagatttttaaaaactatgttggctaaaaaataacatcataaattagaaaccgtacttcatggattcgattttaataaagtgcggttttttctttgctttttataaaaaagttctgttacaaagggtgtttttttgctaaatttagcacaattttttcgttaagctcggtagagcgtttttatacaatttattagcggacttcttatgttattcaaaaaaattcgtggtttattttccaatgatctctcaatcgatcttggtacggcaaatacgttaatttatgtaaaaggtcaaggtattgttttggatgagccttcagttgttgcaattcgcaaggatagagcaggttcacttaaaagtattgcggcggtcggaaaagaggctaaattaatgttgggtcgtacgccaaaaagtattgaagctattcgtccaatgaaagatggcgtcattgctgatttttttgtcacagaaaaaatgttgcaatactttatcaaacaagttcacagtggcaattttatgcgaccgagtcctcgagtgttggtttgtgttcctgctggagcaacacaagtcgaacgtagagctattcgtgagtcagcaattggtgcgggagcgagagaggtttacttaattgaggagccaatggcagcagctattggtgcgaaattacccgtttcaacggcaacaggatcgatggttattgatattggtggtggtacaacagaagttgcagtgatttctttaaatggtattgtttattcttcttctgtgcgtattggtggtgatcgctttgatgaagctattatcgcttatgttcgccgcacttttggttcaattattggagaaccaacagcagaacgtattaaacaggaaataggtattgcttatattcaaaatgatgatgaagtgaaagaaatggaggttcatgggcataatttagcagagggagccccacgcacatttagcttaacttcaaaagatgttttagaagcattacaacaacctttaaatggcattgtgaccgctgtacgtacagcgttagaggaatgccaaccggaacatgcggcagatatttttgagcgtggtattgtattaacgggtggtggagctttattgcgtaatattgatgtattgctttcaaaagaaaccggtgttccggtaattgttgcagatgatccattaacttgtgtcgctagaggtggtggtgaggctttagatatgattgatatgcacggcggcgatattttcagtgatgaaatttagttttaacaacatgaaaagtgcggtagattttaccgcactttttgtcttaactatttaatctgttgtgataaatcaatctttatgaaacctattttcagtaaatcacctcctttaggtattcggcttattttagccgtggtagtttctatcactttaattctgtttgatggcaaaactagtgcaatgattaatcttcgtggttttatggaaactgcggtaggaagtttatattatttagccaatacgccacgtgttatactggacggtgtatcagaaaatttgatcgatacaaataaattgcaaatcgaaaataaagtattacgtgaacaattacgagaaaaaaatgctgatttgctcttgttggatcacttaaaagttgaaaatcagcgtttacgtttattgttaaattcgccactaagaacagatgaatataaaaaaattggtgaaattttaaccgctgaaacggatgtttatcgccaacaagttattatcaatcaaggtgcgaaagacggtgcttatgttggacagcctgttattgatgaaaaaggtgtggttggtcagattatttcagtgggggaaaatactagtcgagtattattattaactgatgtcatgcattctttacctgttcaagttttacgcaatgatgtgcgtgtaattgccagtggaacagggcgaagtgatgaattgactttagagaatgtgccgagatcggtcgatattgtaaaaggtgatttacttgttacgtctggacttggggggcgttttttagaaggttatcccgtcgcaattgtggaaaatatttctcgtgatagcaaaaattactttgccactattacagctaaacctttggcttctatagaacgtttacgctatattttactactttggccaacgcatgaagatatgcgtaaagcacaatctctgacacctgaagatgttcgtaaagcagtgcaacaacgtctagaaatgcagcataattcttctacatataaggtgaaaaagactccggtacaggaggaattttttccatcyaataatacagatgagtattcagtagatatattagaaaccttaccggaaaatttacctgagcaagagtttctacaaaaagagcagggggatgaaaattaatgaaagtaaaatttttgttacaaattttagtgatcagcggtttgtttatttttacttttgctcttgaacttatgccttggccagtaacttttcagagtttcaaaccctcttggctagtgttggttttgctttattggattttagcgattccgaataaaatcagtattggtaccgcatttatattaggtattatttgggatctaattttgggctcgatattaggtgtgcatgctttggttttatctgtctttgcatatttgattgcaattaatcatttggttttaagaaatttatctttatggttccaaggtattcttactattttatttgttatcgctattcgtttttcaatttttttgatcgaattctttttaaatggtgtacattttaattggcaagcgatttttggagctatcacaagtgggatattatggccttggttatttttattattgcgtataattagacgaaaattagatttaagatagttttgttcttgcgaggattaagtaatcacatgccaataatcacacaatttccaatggagttgactttttctaaagttgtttttgttgtgttatgatctccaatgggaccaatgacaactctgttccagttttcactacgtttaattttagcatcgaaaccggcaatagataaacgtgcttgcatgttttctgcttgagcacgatttttaaaagctccacattgcaagccaaatttcttttccggcgaatttacagtagggttgttttgtatagactgtgctgtttgtaccggctttgcggacacaatatctattttctcacgtcttttatcttctttaattcttgcctgttcagccgctttttgctctttttccatttccagcaaaattttcttttgctcttcgcttaaacgaatatcgttatttaacgattgattattatcaataggaactgttcttgtttctagggctttaatgtaactccatacttcttccggtggggtagggaggacgcttttgggtttttcagattttacgggtacctgtatagttgtattcttcgttttggttttcaaaaaatacaacccagccacaaagccaataatgatcaaaagaatcaaggtaattaagaagattttatgctttccttttgtctgttttttctttttagacttcacacctgttccgtaatcttttgccacaataaaatcctgaataacgagtaagtaataaaaatggcaattctactcaaaaaactataactaatctagtactagctcaaatccagcggatctatatctaaaactaaccgcacttgttgtaatcttaaaaaattttcttgctgaaaagagtgtaaaatttgttgtaattctgctttggatttatgttgtaataaaaggtgccagcgatattgccccgcttttttgctaaaaggtgcttggataggccccaagatttgcaagtttttgcttgaggtattatgaaaataggctgcaatttggtgtaacacttcctcagctttttgtgagtggcgactttgggctttaaacagtgcttgagcactgaaaggcggtaaccccatttggttacgcaaagtgagggcttgttgggcaaagtaagggtaaccttgacttaataaactaaccaataaaggatgttccggatagtgggtttgcaagacgacctctccttgtttttcttctcgtccggctcgtcctgcaacttgaacataaagttgggctaaacgttcttctgcccgaaaatcagtagaaaaaagtgcactatccacgtttaacagtgccactaaagttacattggggaaatgatgccctttggctagcatttgtgtaccaattaaaatttggctttttcctaattgaatatcccgtagatattgttccaattttcctttgcgagcggtactatctctgtcaatacgggtaatcttatagtttggaaaacgttggtttaaactttcttccaattgttctgttcctaaacctgtcgtcactaaatgtgtcgaaccgcaatttacacattgcattggaataggtttttgtgttccgcaatggtggcaacgtagaactcgctgatgttgatgataagtataaggcttttcacaatgttggcattctacaatccagccacattcatgacaaagtagaacaggtgcgaaaccacggcggtttaagaacaataaaacctgatttcccttttttaagtgatttttcatcattgtcaacaaggtttcagataaaccgttatgtactatttgtcgctttaggtcgataaccgaatgacgaagtgcggtagtatttcttgctctttttttgagtgtgatgtgacgatatttgccttgtcgcacattattgatgctttccaaacttggcgttgcagatcctaacacgataggaatatccaattgtttagcgtaaactactgcaagatcacgagcatgataacgccaattatcttgttgtttaaatgaaagatcatgttcttcatcaacgataattagccccagttgtttaaagggagtaaatagtgctgatctcgtgccgatgatgaccgcacttttgccatttttagaacgttgccatactttcaaacgttggttatcatttaaatttgaatgtaacacatcaatttcaatattaaatctcgcttgaaagcgttgtactgtttgtggcgtgagaccaatttccgataccagtactaaaatttgtttctcttgttgtaaaatttcctcaataaattgaagatagatttctgtttttcctgaaccggttacgccttctaataaccaacagataaatccggattgaaaggttaattggctgagtgcaagagcttgctcttggttaaggggaaggcgatcgttagtttttacaatagattgatgatttaatttttgttgccaagagatacttgttttatgtatttcttgttcagatatatatcccttactttttaaggtgctccaaacttggttatgaaaaggattgttatttttttctgtgatattgttttgtagataatgcagagcctcaagctgtttttttgctctttttaatttgttgttgtctaatgcttgttgcccttgttccgttagttgaaagaaaaatgttgatttttctaccgcactttcaccacggcgtaatttgcttggcaagctgcttattaatacttctcctaagggaaattgataatagtccgctccccaatgtagtagacgccataattcaggggtaaaaacagaatgatgatcaagaacggagataatgggtttgagttgtgaaatatctatctccgttttttcaggtaactcagtgacaataccaattaatttttgtcgtccgaaagggactaatactcgacagccgacagcggttgaaagggcatttggaataagataatcaaaaaaactaaacagaggaacggcaagagcaactcgtgcaagtttcattatgttattttccttgcgtagtttgtgtgatttcatctcgtttaacttcatcccaaaaaatatccatttcagttaaagaggtattttcgaaggttttgtgtgcttcacgcaatttttgctcgacggcacgaaaacggcgttcaaattttttattggctttacgcaagctttcttcaggattacattttagatgacgacttaaatttactaccgtaaaaagaagatcgccgatttcttcttcaatttttgtttgattgataggatttgtttgatattcctgtttaacttcttctaattcctcttgtactttagctatcacaggattgacattattccagtcaaaacctattttggcacagcgtttttgtaatttttcggcacgcttcaatgccggaaaagcatggggaatattatctaagattgattgatgtcctttttgaatatattcacttgcttttgctttgttccaattttctaatgcctcgtctgcattattggctttttgttctccgaatacgtgtgggtggcgacgcaagattttttctgtaacggtatgtactacgtcatcaaaagtaaaatattgatcttccgtagcaagttggctaaaaaatacaacttgtaagagcaaatcacctaattcttctttcagatcagacatgttattttgctctattgcttcaatgacctcataagtttcttcaattaaacaagtgatcatcgaacgataattttgctttaaatcccaaggacaaccattattaggatctcgtaattgggcaatgatacgaataaaatcttgaatgtggtagctcataaataatctcatgaaataaatagtatttgaaataaggatatcatagccttgaatgaacaaaaaaatgaaaaattttttaaatttttagccacactgtcccaggaaatgacgatgaactatcatttgataaatatattgggtcgatgagtgcctctattatgtgatgagtgcaccaagactgacaagcatttttttgaatcaaatattaaaaaattatgctcatttctaaaaaaacattttgacatcttgatgtttttagtttgcaagaaaaaagccatagattaacgaggtatttggtttatggagctgacttttattttttattttattcacataaggaaggtattatgttaaagaaattagacccaagtaaagttgttggacttaaaaaccaatcgaactgcaaaacaattatgacaattggtgttcaagacaagaaataactccagttgagaagacactaggttgcaatctagtgtctttttttattaattagattttaaggataatgaatgaactttaatgatatttataatccaaaccagtctttggcgatttcgttgcatagtgcaaataacaaaaagagtgtagattctttttattatttattggatgtctgtgatgaaatcttggatgtaaactccaaagaaaatataataaaaggcatagattttataaaatccaattcgatattgagaggtgttttatttcactttgttaatcatcttgttaagtcaatttctaaaaatgatattgatgaaataaaagatgtatttacttattttaataattttatcttattttatagctgagaaaaaataattttttctggtgtaggaaatataggtaacttatatctaaatcagtttaataaaattaatgatgatgcctatgagttttcttgtgcacctatcaaggatagtttaattaataaatataggttaaaaattaataatcttatgaaatttatcagagatattgatttagaaacctatatggaaattgagaatatagtcgatgatatatatgtatttggtgtgaattttaaagatagtcaagaaatgatttattctggtagtgattttgccaaacttggttgtattttctttaatgaagatattttttttgataaagatgatttgtttatcttggataagattatacatgaatccgctcatcagatattattgtctgtaatgatacatgatgaagttgtgctaaattcagatgatgagcgttatccatcacctcttagaactggactaagaacaatgaatggtatatatcatgcagcttttgttttgtatcggatagcaagatcaagattttttaatcaaattattgagagaaaaaatactcaatatccttataatcatttgatttcttattttaacaaaaataaagaacaatttttggtttgttatgatgttatttctaaaaatggaaaattaacagatttaggaaacgttatcatcgaaaactattataaagaattaaggagtatgtctagtgaaattgacagataagctatctaaaaaaaccattgaattgatgcaaagatttaatgataatgcggtaagaagactaaatgatgatttatatccaatagcaccagatttggtcgaaatgcttattgattcaatttacggtaatgtttatcaaagaggtgttttgagtattaaagaaagacatatagcaacgctatcggcacttattgccattgggggctcagaaaggcaattgtcgtttcaagggtttgctgcttataagcttggtatcacaaaagaagaaatccaagaaatattgatacaaaatgcaatatttagtggatttacgagagcgatgaatgcggctgttgtgcttgatgaagtgtataagaaatatttacaagggaaagatgatgaagcataatgatttttatcgttatcaattagcagaagttatgcttaatactggcataagaactattggatttttgtttgcttggcttatgctcactacctttcatcaacctcagcatttaggtgtttttattggtatttcttgggcgtgtcaggtgttggcattgcttttattttcttgggtgtgcaaccagtctacatttattatttatagtaaaaagttattgttgcctttttgctttatttgttttttgttttttttggcattgttttttgttcataattattttgtttttggcatagtttttatcgttagttctgtttttaccattctcttgaatccattggggacgagtcttaccaatgatttgtatgatggtgaagataaatcaaatggatttaaattgcgtggttttgtgaattctattaataccattatttcccctgctatttccggatttattattcactattttaatacacagaagattattgttttttgtatcctattatctttattaagtggtttcttattttattttataaaaaatataaaattacaagaaaacttgggaaaaaaatctaaaaacacccttaaaatactattgaaaaaccctattgaaaaattgatggtttgtgtatcattattagctaattttattatcactcctattatttcatatattattccttacaatatatccaacaaatttaatttatcggcattttatatcggtattagtgaggctttctttggtatcggtatgataataggtagtgtttattttctaaaattgtttaataaaaaacttggcagtcatcatagtttggtattaagtattttcttggtgatgataggtattttgttttctgtgacagataatttttatattttttgtttttctttaatgacgattggggttggtgttgtgatgtttaatattaacagtacacatattcgctgtacggcaactcccaaaaatattcgtaccagttttgaatttgtttttttagcgtgctgtattgtatttattccaattggcgtattgttaacgacttgggtattaaataatggagctttggtttatttttatggaattatttgtttgattatgttggttttgtctttaatgatttttaaaaatactgatattgttcacattcatcagcttactgatgataagctagatggttattatcaggttttgtatcccaaaatttatccataggtgtgggtgttgtggtatttggattgtggcactgccctagcaggggcggaggtagagtatcaagacaaacaagtgatcatcgaacgataattttgctttaaatcccaaggacaaccattattaggatctcgtaattgggcaatgatacgaataaaatcttgaatgtggtagttcataaataatctcatgaaataaatagtatttgaaataaggatatcatagccttgaatgaacaaaaaaatgaaaaattttttaaaacgtgatctggtgcaaatttttttatttttattaatgctagtatagttccaacagttagttaaattcattaagctaaggaggcaattatgtataaacacgtattagtggctgtagatctttcagatgaaagtggatttttactcgaaaaggcagcaaaaatagcaaaacaatatggtgctaaattatcggttatccatgttgatgtgaatttttcagatctttatacgggtttaattgatgttaatatgtcttcaatccaagatagaatttcaactgaaacacatcaagccttgattgagttatcagaacaatctacctatcctgtttctgagaaattgagtggtagtggtgatttagggcaagtcttatctgatgctgttgagcaatatcaggttgatttattagtaacaggtcatcatcaagatttttggagtaagttaatgtcttccactcgtcaagtgatgaattcaattaaagttgatatgttagttgtaccgcttagagaagaataaatataaagaatttgtgatgggcagcgtgagttgcccttttttattagcattgaaatattgttttgcataatgcgttattacttcttgagagaatatgaataatcagctaaaaaagttttttataaatgtcaaaaatatgcaacaataagcaggttttttactggatttacaagatataacaaggttttttaatgaaaacaacagcagaaattagacaggcttttttggattttttccatagcaaaggacatcaaattgtagatagcagctctcttgtaccggaaaatgatccaacgttactttttactaatgcgggaatgaatcaatttaaggatgtttttcttggattggatacccgttcttatacgagagcaactacagcacagcgttgtgtacgtgcaggcggtaaacataatgacttagaaaatgttggttataccgctcgtcatcatacttttttcgaaatgcttggtaattttagttttggagattatttcaaacaagatgctattaaatttgcttgggaatttttaacttcaccagaatggctcggattaccagaagaaaaactatatgttactgtttatgaaactgatgatgaggcctatggtatttggcataaaggagttggtgtgccggaaaatcatattattcgcattggtgataataaaggtgccccttatgcttctgataacttttgggcgatgggtgatacaggaccttgcggtccttgcactgaaattttttacgatcatggtgagcatgtgtggggcggtttaccaggtagcgaggaagaagatggtgatcgttatattgaggtttggaatattgtatttatgcaattcaatcgattggctgacggcacgatggaaaaattaccaaaaccttccgttgatacggggatggggttagaacgcattagtgcggtaatacagcatgtaaattcaaactatgatattgatattttccaaaaattaattgctaaggttgcagaactgacgggggaaaaagatttaactaacaaatcgttgcgtgttatagctgatcatattcgttcttgtgcctatttaattgcagatggcgttattccttctaatgaaggacgtggatatgttttacgtcgcattatccgtcgtgcggttcgtcacgggcatttattaggtgctaaagacactttcttttataagctcgtaccggttttgatcgatgttatggctacagccggtaaagatgtaaaagcgaagcaagccaatgtagagaaactgctacgattagaggaagagcaatttgctcgtactttagaacgtggtttagccttgttagatgaggctttaattagcgtaaaagatggtgtgttatccggtgaagtagcatttaaattatatgatacttacggttttccattagatttaactgccgatgtttgccgtgagcgtaatattcgtattgatgaggaaggcttcgagcgtgaaatggaagtgcaacgcttgcgtgcacaggcggcaagccgatttggtgtagattacaataatgttattcgtgtagaagggacaactacttttgaaggttatactgaggctgaaactcaggcaaaagttaccgcacttttctatgaaggcaaatccgttgagagtattagtgcagggcaaagtgcggttgttattttagatgatacaccgttttatgctgagtccggcggacaaataggtgatagaggttgcctgattgcgacaaatatgcggtttgacgtgaaagatacgcaaaaatatgggcaagtttttggtcatatcggtacgttaattcaaggcacattaaacgttggtcaaacaatcaatgctgttgttgatacggaacatcgtacaaaaacttcattaaatcatagtgctacgcatttattacatgcggctttacgtcaagtattaggtactcatgttgcacaaaaaggctctctcgtatcagatactatattacgttttgactttgctcaacctgaagcgattagccaagaacaattgtttgaaattgaatgcctcgtaaatcagcatattcgagctaatcatttggtagtaaccgaagttatgcctattgatgaagccaaagctaagggggcaatggcattatttggtgaaaaatatggcgatgtagtgcgtgttgtgaaaatgggcgagttttctattgagctttgtggcggtattcatgtaaaacgtacgggtgaaattggtctatttaagattgtttccgaatctgctattgcggccggagttcgacgtgttgaggcagtaactggagaggttgcaattaattggttgcaacaacagcaacagatcttaatgcaaagtgcggatcttttgaagtctgatgcaaattcattagtcgaaaaaattcagcaattacaagataaagcgaagaaaacagaaaaagagttgcaagcactaaaagaaaaatctgcgatgaaggcgggttccgatattgctaaaagtgcggtagaaattaatggtgtttctgttattgttcaacagcttgaaaatatggatgtaaaatctttacgtgttattgtcgatgatttgaaaaatcagttgggatcagcggtaattgcttttgttacgaagaacgaagataaggttaatctagttgttggcgtgacaacggatttaacctctaaagttaaagcaggcgaattagttaatttaatggcacagcaagtgggtggtaaaggtggcggacgtcctgatatggcaatggcgggtggatcacagccggaaaatatctccaaggcgttaacagtttgtaacgaatggttacataaaaatttataaagtaaaaattttgtgttgtggctcacatttttgaatattattcatctctttgtgggaataaataacgtacaatgtaagtcggataacacttcattattatcatgctttattattataacgctttgttatttaaggattttaagcaagatagagatcttataaattcaactgaaatgagagggttatatgctgatattgaccagaaaagttggcgagagcttactcattggcgacgatatttctatcacaatattaaatatacgtggcaatcaagtaaaaatcggtgttgaagcaccgaaagaggtttctgttcatagagaagaaatttatcatcgtattagagatgttaaagatgaacagcagttgtaattggctttttgaacgataagatatggagaaattatgagtaaactaacttgttttaaagcatatgatattcgaggtcgtttgggtgatgaattgaacgtggatattgtatatcgtattggtcgtgcatttggacaatttttaaaacccaaaacgattgttgtcggtggtgatgttcgtttaacaagtaaagaattaaaaagtgctgtaacaaatggtcttttggactcaggtgttaatgttattgatttgggagagacgggcactgaagaggtctattttgcgacttcattcttaaaagctgatggtggtattgaagtaacagccagtcataatcctatggattacaatggattgaaacttgtacgtgaaggttcgcgtccgattagtgcagatacaggtcttgcagatattcaacgtcttgcggaagaaaataattttgctccagtttcccaacgtggggagtataaacaactttcagtattagggcattatattgagcatctcttatcttacattaatttggaaaatttaaagccaatgaaattggtgattaattcaggcaatggtgcagcaggtcatgttattgatgctattgaagcacaattccgagctaagcatgtgcctgttgaatttgtgaaagttcacaataatccggatggtactttcccgaatggaattcctaatccgattttgcatgaaaaccgtcaagatacgattgatgccgtgttagagcataaagctgatatggggattgcttttgatggcgactttgaccgctgtttcctatttgatgaagagggcggttttattgaaggttattatattgtgggattattggcacaagcatttttacagaaaaataaaggggctaagataatttatgatccacgcttaatttggaatacgattaagttagttgaagataatggcggcgaagcggttatgtctaaatccggacattctttcatcaaagaaaaaatgcgtactgttgatgctatctatgggggtgaaatgagtgcacaccattatttccgtgattttttctattgtgatagcggaatgattccttggttgcttgttatggagttagtgtcaaccacaggtaaatcactaggtgagttagtggggaatagtcttgaaacctatccatcaccgggtgaaattaacagtaagttagttgatgcgaagtctgcaatagagcgtgtgcgtgttgcttatgaaaaagaggcagtcagtgtagatgaaactgatggtatcagcattgagtatccaaattggcgttttaatttacgcagttcaaatacggagccggttgttcgtttgaatttagaaacacgaggcgataaacaattgatgacagaaaaaacagaagaaattctcgctttattgcgtcaataaattaaacttaagtaagaccgcactttgtttccgcaaagtgcggttatttatggctctaattaaggaaattaaaatgaaagtaattattcctgttgccggcttaggaacgcgtatgttgcctgcaactaaagcaattcccaaggaaatgttaacgttggttgacaaaccgttaattcagtatgtcgttaatgaatgtgttaatgcagggattaaagagattgtgctggtaacgcattcttccaaaaatgctatagaaaatcattttgatacatcttttgagttagaaactatgttggaacagcgtgttaaacgccagcttttagatgaagttcgttctatttgtccgacaggcgttactattatgcatgttcgtcaagggaatgctaagggactagggcatgctgtactttgcgggcgagcaattgttggcaaggaagcttttgccgttgttttacctgatgtattacttgctgaatttgatagtaatcaaaaaacagaaaatcttgctgcaatgctgaagcgttttaaagaaacgggaaatagtcagataatggtttcacctgtacctgataaagatattagtagttatggtattgttgattgtggcggtgttactttaaatgttggtgagagtgttaaaatctcaaatattattgagaaaccctcatttgaggacgcaccttccaatttgtctgttgttgggcgttatgttttttcagcgacaatttgggatctattggaaaaaacgccagttggtgtcggtaatgaaatccaattgactgatgctatcggtatgctaattgaaaaagaaattgttgaagcatttcatatgaccggcaaggcttttgattgtggagataaaataggatatatgcaagcctttgtggaatatggtttacaacaccctcaattaggggagaattttaaaacctatttgaaacaactggtgcaggacttgtagaaattcgttatggctaaactttgtcggttctttaatataaaattttattaagggaccgattttttgtgattaaaaacagctatcaattcatttactttaattcttttgtgagatgatttgctaatagaacgctgaacttttaagcgtttaatttttgcgtctttgtagatctctctagtaaatttggtatcgtggttagagattaagaccggtacaccgtggtttagtgcggtatcttttgccagttgagctaaattttgttgatgagataaagaaaattcattgcctgagtagctggtaaagtttgagttttgtttcaatggtgcataaggcggatcacaataaataacagaatcattattgatcattgaaaatgcttgttggaaatcagcacaaataaacaccgctctttgtgctttttgggcaaaataacgtagttcagactccggaaaataatgtgttttataactaccgaatggaacattaaattcatttttagcattatatctgcataatccgttgaaaccatatctatttaagtacaaaaacaaaaccgcacgttcaaaaatattttgcgataaattaaattcagctctgcgatggtaataataattagcggtattagcttgatcatggaaaaatactggtttgcatgccgcaatataatgttcaacatcttgctttacaatattaaatagatggatcaagtcagggttaatatctacgagaatatagtgttcaaaatgagtatttaagaatacagaaccagcaccgacgaaaggctcaataaggcaagttttatttttaggcaaaagtttgttaatttcctctgttaagcgaaacttaccgcctgcccattttaaaaatgggcgatatttcactaaattagaagaagttcctttgttggacatgaaagattaacttttttttgaacaggtacgaattgcatcaagcacgtattctttgtctgtatctgttgcaacgtaggcttgaccaagtgattttagtaagactaggcgtaattttccagcaagaacctttttatcacgcatcatatgtggtagataattttcagctttcattgtatcaggtgaggctgtaggtaaatctgcttgagttaaaagtttctccagtctcgttacatcgttaagtgataaatcacctaattgattagacaagacggcagctatcatcattccggttgcgactgcttctccatgcaaccaatttccatatccaaggtgagtttcgatagcatgcccgaaagtatgacctaaatttaataacgcacgctctcctttttcagtttcatcacgagtaaccacatctgctttaatttgacaacagcgagcaatgcactgctgtaaatattgttgttctaaagcaactaaattagttatatgtttttctagccatgtaaaaaattcatcatttaaaatagcaccatatttaatgacttcagctaaacctgcgtgaatttcccttttaggtaaagtagttagcgttagcgtatcaataataacggcacaaggttgataaaaagcaccgatcatgttttttcctaatttgtgattgacagccgtttttcccccaacggaagaatctacttgagcaagtaatgtggttggaatttgaataaaacggataccacgttgatagcttgccgctgcatatccggcaatatcaccgatcacaccgccacccagtgcaataatagaggtatctcgtccatgattagcttttaaaagtgcggtaaaaattaagtctagagattctaaagttttgtattgttcaccttctgggagttgcacattctctaccgagcaaccaattttttctaaggtgtctgttacagaggataaataatactgtgcaattgtagggttagttacaatcatcactttatcgcctttttttagcggataaacttgtgcttcggataacaaccccattccgatatggataggataactgcgttcccttagttctacatttacacacagcattttatacctcaaaatgtaattagattttaagattatcaattaaatcaatgatttgattcgccattaatttggcactttgctcgtctgtcggcaaaataatatcagccacttcttcatataaagggttgcggactttggctaaatcttctaatacttggcgaggatcttcaacattttgcagtaatggacgttttttatcacgttgagtacgttggaattgtttttcaacggtcgtttctaaataaataacggtgccacgagcagataaataattacgattatcttttgatacgattgcaccaccaccggtagaaagcacaatgccttgtttttgagttagttcattgatgatacgttcttcgcgtttacgaaaaccttcttcaccctcaacgtcaaaaatccaactaatatctgcacctgcacgttgttcaatttcggcatcagtatcaataaattccatgcctaaaatttgtgctaattgacgaccgattgtactttttccagcccccataggacccactaaaaaaatattacgtttttctgccatttgtacttcttctttacaaataaaattaaaaaattgatcttataaaaaacaaacgacctaaaataaagaggtcgtaaaagatcgcccaaaaataatggagattatctcaataaatgcccccttttttcaacctaaaaggggatttattttaagatttcattaagtgcggtttattttaatactattttaatggttttattatttcatcaggttgttctgaacgaatgatccttggggtaacaaaaattactaattcacgtttttggtgtctttcactttcacggctgaacagtctttttaatataggtatatctcctaacaacggtactttatctactccttttgtgattgtatcgtgaaatacgccacccaacacaattgtttccccatctcgtgcaaaaacttgagtattaatttcttgtttatcaatagataccatttcattttgcccataagtaatacgacttccaggggagttttggcttacaaggagatccagcaaaatagtattgtctttagaaatgtgtggcgttacttctaatcctaaaactgcttctctaaactctactttctgttcatcagatttcttgccggtaataacataaggaatttcagttccttgtttaatacttgcactttgcttattcgttgtaagtaaacgagggcttgcaataatttctacattattttctcgttcaagtgcggtaagttctaagtctaaaagtcgatcattaattttggcaatttgtaaagcaatagaacctgcaggtgttgcggtagtagcaaaattgacgttaagttgttccgttaaatgctgaaatccgtttgccgctagattgcctgaaagatgatgagcgttatttgtaggctcaaaaattccccaacgaacccctaattcttttaaattttcatcactaattgttacaattctcgcttcaattgcaatttgttcaataggttgatccatttctttgattaatttttttaaggcattgagagtttcctgattatcctgaattaagagcaagttacttcgttcatcaaaactaaaagttccatttgatgaaagccatgaaccttgacctgtagtcagtgatttcattacatcagccgctttagcataatgtaatttgatcgaagtcgtcgttaaatttggctcattagtcgattttgacaaattttcctttgtatctaattgtatatttgtctctttttttatgcttctttgtcttttatcaaagggatctctagcagataattccacacttactgtgaataagaacaaaaagaaatataagaaatttttaattaacataggtattctccatgactaaagttgtaaagaaatatcggcttgaatggaaaaatcttcattttcactatgagaaatttgcaacgaaactaaattgagtggaacttgaggtaaaagagcggttaaaaattgagataaatcggaaaaatagcctttaacgtgaaaagttaaaataggttgatttcccatttgccaatgagattgttcaaataataattttccattatttaacaattgtaatttttgattaatttgtgcaagaggtttattaaactcaatattattttgttgatagcgttcctttaagctggttaatatttgttgcctgtgaacaagtcgagcatttttttcgtcaatttcaacttgaagtttttgtgcaatttcttgttgctgaatataattgagcgagggataaattgagcttatcaaaattattaagaaaaaaattaaaatttgttttagtgaagataaatttacccattttactaacaaattatcagaatgctgtaacttcatgatctattccttatgttgagttaaacttaattcaaattcaaatatgactgatcttctctgatcaatttgttgttctttaaatgtcaacagtcttacacttgaaaacaaattttgttgtttcaagaatttttgtagctgttcaacttcattatttttctccgtttcaccttgcaaaattaatttttcaaaatctaaggacagctcgtttaattccccactttgtaacggaagtttagaaattgttgttaatattgataaaaattgttcattcggtaatttttttaagttttttgatttaccgccataatttctttgtaatgtagaaatgttctgttttatttctgcaagtttattgtcaatttgttgtatttgctctctttttttatctatttcggtgtcaattttttgagttaaataaagtataaaagtcacaccagcaagacagataatgaggctggcaagtgatttataaataaacgattttattttttgtcgataaatttcttgtcgccaaggtaataaattaatttcaatattacgcatttattattcctttaattccgttatttgatagagttcatttcttccccaaagagcatttcctaaagcaataaaaggcaattcggtattaatgatgttccatttatgagtgatattttgttgttcatttttttcacaatagcaccaaacttgttgaggttggcagttaaaacgttggcagaattcttgataaagtgcggtaatatttttgtcatttttttgtagaacgattgtttgttgtccgatttcttgtattgctatacagccgttacgatcctgatataaatataatgtttccatcttttcttttggggggtgaaaataatggaatgctcgtagtaggctattgcttaagcaatctaacgtattaatttttatagggaaaaaacgatgcacataattttgagctgtttgttttctaacaacatagatagccagttttgcaccttgtgttaattctttatattggtagtcgtaccaaatatcaccgaaatctgtcggcaattcattttctatgattaagttacattgttgttggcattcttgctcatttaacttttgcgtcaatatgattgtttttacccagacgtgctgattgggtaaacaggctatccatgtgcagatattctttgcgaattgtggtgtcaaatcagatagtttaagagggggattatcgtttttagttaaaaagtgcggttgtttttgttcatcaaaccagaggaattgccattgttcatcttgtctatgaataccaatttgtaaaatatttgctgtttttttgttaggtctcatttcatattctctttaataaaatttatattttaaaacttagctttattagctaaatcctttatacttacctcattgattatcgatatatttttttcaaatacattaaataagagagaattttacgatgaggatcgcaaaattaatatttagtaccttactaacgttgattattttagggtgtgttgtagtcggtattttttacattcagataaagaaagatttgcccagtgttgatggtttaaaaacagttgagttacagcaacccatgcaaatttatactgctgatggaaaattgattggtgaagtaggggagcagcggcgtattccggttaaattgcaggatattccacaaaaattaattgaggctgtattggccacggaagataatcgtttttatgaacatcatggattagatcctattggtattgctcgagctattagtgtagctatcagcaaaggaaatgcttctcagggagcaagcacgatcactcagcaattagcacgcaattttttcttaacaccggaaaaaaatcttgtccgtaaaattaaagaggcaattttagccattgaaattgagcatgttttaactaaggatgaaattttagagctttacctaaataaaatttatttcggttaccgtgcttatggcgttgcggcagcggcaaaaacctatttcggtaaagaattatcgcagttaactttatctgaaatggctgtcattgccggattgcctaaagcaccttcaacaatgaatccaatcagttcattaaaacgtgcacaggatagacgtaatgttgtattggggcgtatgcttgagacgaactatatttctaaagctgaatatgatgcggcgataagcgaacctattgttgcctcttatcatggaacacagttagaatttcgagctgattatgtgagtgaaatggtccgtcaagaaatggtaagacgctttggcgaagaacaggcttatacgaaaggatataaggtattcacaacgattttatccaaagatcaggcacaagcacagaaggctttacgtgagaaccttattgcttatgacatacgacatggttatcgtggtgcggtcactttatggaagaaaaatgaaaaggcttgggaaacagaggcgattgtagcacatctaaaatctttaccaaattctaatccatttattcctgctgctgttctgtccataagtaaaacgggagctaacttgttgttagcggatggtaagaatattactttatccaacaatgcgatgcgttgggcgggtaaaaaaatgcctaaagaaggtgatcaaatttgggtaagacaacagaataaagaatgggttttagggcaaattccggaagctaattctgcattagtttctcttaatagtgataatggggctattgaagcgttagttggcggttttagttttgagcaaagtaaatttaatcgtgccacacaatccttggtgcaagttggctcatccattaaacctttcatttacgctgctgccttggagaaaggattaactttatcaagtgttttattggattcggaaattgttattcaaaaaccggggcaagaaccttggacacctaaaaattcaccaaatcgatatgatggtccaactcgattacgtgtaggattaggattatcaaaaaatatgatcgctattcgtgcgatccaaatggcaggtgttgatttcagtgccgagtttttgcaacgttttggttttaagtcggaaaatatttttgccagtgaagcgatggcattaggtgcagcctcttttactccgttggagatggcaagggcttacgcagtatttgataatggcggttttttagttgatccgtatttaattgaaaaaattcaagataatatggggaatgatgtatttattgcgaaccctaaaatagcttgtatcacttgtcatgatattccggtaatttatggagaaacagagaaattagacggatttaaagagaatacatctatatcggataatgccaatgccttagatttagggggggaggaagtcagtgaaattactgatatacccgaattaaatacggttagtaaaaaattagatgaaagtgcggttctctttatggctgaggcgaagacggagcattcgacggaacaatatgcacctcgtgtgatcagtggtgaattggcttttcttattcgtagtgcattaaccagtgcggtctttggtgaagaaggacttgattggaaaggaaccagttggcgaatggcagaacacttcaagcgtcgtgatattggcggaaaaacgggtacaaccaataattctaaggttgcatggtatgcgggatttggtgcaaatctagccactgtggtatatgtcggatttgatgataataaaaggagtttaggaagaggagaaacaggctcggcaacagctatgcctgcatggatttcctatatgaaattcagtttaaacgatattccggaaagaaaacttgccttaccgccaaatatagtggaaaaaaatattgatgttagatccggtttattggcagaaacgggagaagggaaaatagaatactttattagaggtacggaacctaaaagaacattcgttcaacaaggacgtggttactaccttccttctgaaacggatctgccaagtgcggaaccggaagaaattttctaaaacaaaccgcactttgtaaaagtgcggtctatctttcattattttataaggctaagtttatgctaagttatcgtcacagttttcacgcaggtaatcatgctgacgtgttgaaacatattgttttaatgttgattattgaaaatttaaaattaaaagaaaaaggattttattatttagatacacactctggtgtcgggcgttatcgtttattcggtgatgaagcggaaaaaacagcggaatatcgagaggggattgctcgactttgggcaaaagaggatttacccgaggtaattcaacgttatatttctttaattaaaaagctgaattacggtggtaaagaattacgttattatgcaggttcgcccctgattgccgcacaacttttacgctcacaagatcgtgcattgttaacggagttacatccggcagattatcctttgttacgcaatgaatttaaggaaatcaataacattagtacaaagcgggataatggttttcagcagttgaaagcgactttaccgcctaaagaacgtcgaggtttgatcttaattgatccaccttatgaactaaaagaagattatgatcttgtggtaaaagcaattgaagagggatataaacgttttgcaactggtatttacgccctttggtatccggttgtattacgacaaaaaactaaacgaatcatcaagggcttggaaaatagcgacattcgtaaaattttgcagattgaattagcggtacgtccggactccgaacaacgaggaatgactgcaagtggcatgattgtgattaatccgccatggacattagaagatcaaatgaaaaaaatcttgccttatttgacccgcactttagtaccagaaggaaccggtaattggtctgtaaaatggattacgccggaatagaaaataccaatcaaattaatttattcaggcatttggtttttttggcaaatttttagcagaatacataaacttaaatataggagagaaaaatgactaaacattatgattatattgctattggtggtggtagtggcggtattgcttcaattaaccgtgctgcaagttatggtaaaaaatgtgcaattattgaagcaaaatatttgggcggtacttgtgtgaatgtcgggtgtgtgccgaaaaaagttatgttttatggtgcacaagttgctgaagctattgcaaaatatgcacctgattatggttttgatgttacgttaaatcattttgattttgccaaattggttgaaagtcgtcaggcttatatcgatcgtattcatacttcgtacaacaatgtgcttgcaaagaataatgttgatgtattaaatggatttgctaaattttttgatgcaaaaaccattgaagtgagttatgcaaacggcgaaaaagagctggttacagcggatcatattttaattgctaccggaggacgtccgagtcgtccgacaattccaggagcagaatatggtattgattctgatggtttttttgcgttgaccgaattaccaaaacgcattgcggtagttggtgcgggttacattgccgttgaattggcgggcgttgttaatagtttaggtgcggaaactcatttatttgttcgtcggcaaacgccaattcgtagctttgatccgctgattattgaaactcttgtcgaagtaatgaaacaagatggtattcaattacatacgcaagctattccacaagaaattatcaaaaatgcggataattctctaacaattaaattagaagatgggagaacgcaggacgtagattgtttaatttgggcaatcggtcgggaacctgccactgatgtgattaatttggcttcaacaggtgtagaaactaacgaacgtggatttatcaaggtagataaatatcaaaatacgaatgttgaaggtatttatgccgtcggtgatattattgagggaggaattgaattaacgccggttgcggttgcggcaggtcgtcgcttatctgagcgtttatttaataataaaccggatgagcatttagattaccatcttgttccgacggtagtatttagtcatccaacgataggaactgttggtttgactgagcctaaagctattgaacaatacggtgcggaagcagtgaaagtttatacatcttcttttacaccaatgtatagtgcggtgacttcacaccgtcagccttgccgtatgaagctggtttgtgttggtaaagaagaaaaaattgtcggtttacacgctataggttttggtgtcgatgagatgattcaaggttttgccgtagcgattaaaatgggggcaactaaagcggactttgataatactgtcgctattcacccgacaggctcggaagaatttgtcactatgcgttgataaaagtgcggtattaattaatgaaaaaaggattgttctctaccttagaggtcaatccttttaatagcgtatcttgatttagaaagatattctcgagctttcaaataattagacataaaaaaaataactgttatactgatcaacgagtggagaattcggtttatcttcaatctatctcctataattagtataagaaggaaaagaaaatggcaaaaggacaatcactacaagatccttatttaaacgcattacgtcgtgaacgtattcctgtatcaatctacttagttaatggcatcaaacttcagggtcaaatcgaatctttcgaccaatttgttattttattgaaaaatacagttaaccaaatggtgtataaacacgcaatttcaacagtcgttccggctcgttcagtttctcatcataatagtgttcagcatcaccatattgttcaaactcaagaaatgcaagcggaagcattagctgaaaatcaaactgaataattttgaatacaaacaagcaattcaaagtatataccgcaagtgcggttgattttgcccaagatcctaccgcactttcttccaacataaatgtgcctcaatttgacaaagcaattgtggttcatgttttcttttctcaaaataaaaatctagaggatttacaggaattccaacttttggttaaatcagcaaatgttgatattctttcaataatcacaacctcacgctccacgccacaagctaaatattttgttggacaagggaaggcagaggaaattgctcaagctgttgaacaactcaatgcggatattgtgttagttaatcatagcttaacacctgcacagactcgtaatttagaaagtatctgtcaatgtcgtgttgtcgatagaacaggattgattttagatatttttgctcaaagagcgaggtcgcatgaaggaaaattacaagttgaattagcacaactcagacaccttgcaactcgtttagtccgccgaaaaacaggattagatcaacaaaaaggtgcggttggattgcgtgggccgggtgaaacacaattggaaacagatcgccgtttaatcaaagttcgcattactcaattacaaaatcgcttagaaaaagtagcaaaacaaagaaatcaaaatcgtcaaactcgccgaaaagctgatattccgacaatttcccttgtcggttatacgaatgcaggaaaatccactctatttaatgtgctaactcaagctaatgtttatgtggcagatcaattatttgcaactctagatcccactttaaaacgtttaccaattcaagatgtagggaactgtgttcttgctgatactgttggatttattcgtgagttgcctcatgacttggtttctgcgtttaaatcaacattacaagaaactactgaagcaagtttattgcttcatgttattgatgtcgcagatagccgtaaattagaaaatatgttgacggttaatgaagttttaagtgagattaaagcaaaccaagttacaacacttttagtgtataacaaaattgatcaagtcgagaatattcaacctcatattgaatttgatgaagaaaatcaaccgattgctgtttatctttctgcacaattaaatcaaggtttggatttattagttgaggctattcgacaaaaattaagccacgaaattctacatttagagatcaatcttgctgcacaatacggtaaaattcggcattgtttttatcagcttaattgtgttcggcaagagaaaatcaatgaacaaggtgaattcttacttgatgttcaaattgataaaattgaatggcttaaattaagtaagcaatttccgctattgaaacgtttttatgaatcaacagaaatcagcgacaaataaaccgcactttttaagtctatttgacaattccgtattgttttaatttattggcaatggctgtatgcgacatccctaaacgggctgccaacttacggctacttggatattgctcataaaatttttgtaacaccattgactcgaacttattcattatttgttctaaggtttcaccggcaaattgatcaacattaaccggcaaaatttcttgctctgataagtttaaatcagcaattgccaactcattatttttggctaatgagcaagctcgatataaggcattatataattcacgcacatttccagcccaagtataatttttcagatattgaataaaccgctcattaaagtgcggtactgaaatagaaagtttttcactaatttgacgaataaatatttctgtgagaggctcaatatcttctactctttcacgcaacggtggaatagtcaaacttaaaacatttagacgatgaaacaaatcttcacgcattttaccttgttcaacatagtgttgtagcggaatttgcgatgtgcaaattactcttacatttgcacaatgttctttttcctcgccaacacgacgaaaagtaccatcgtttaaaaaacgcaacagttttgcttgtagctctaaagaaagttcagcaataccatctaataataccgtccctctattggcatattcaaaaaagcctgttgtttcaattcccttatccaaacgaccgaacatttcactttctgcatcttcagcaggtagccccgcacaatttatggcaataaacaagtgatccttacgaggaccggcattatgactggcttttgcaattaagtctttccctgttccggtttctccttgaatgagtaaaggtgcgtccaatccggcaaaagcttttgctgtttcaattaacgtctgcatttttacacttttacatacaatatcatcaaaagaaatcagctttgtcataatttaccccatttaaaatcaattgattttgtattctaaacgttgaacaaaaaatgtaaagaaaaatgaacaccaaagataaaaatgtttactcttgatctacatcacaaaaccgaacatttacaggttcagtcagttccaacactactactaaagtgttaaaatctcctcaaatttttaaattcactttaatagcgaggtataaaatggcatttcgtatcgaaaaagacactatgggcgaagttcaagttcctgctgataaatattgggctgcacaaacagaacgttctcgtaacaatttcaaaatcggtcctgaagcttcgatgccaaaagaaattattgaggctttcggttatttaaaaaaagccgccgcttatgcaaaccatgatttaggtgtgttaaatacggaaaaacgtgatttaatcgctcaggcttgcgatgaaattcttgccaataaacttgatgaccaattccctcttgtaatttggcaaactggttcaggcactcaatcgaatatgaatgtcaatgaagttgttgcaaaccgtgcacatgtcattcaaggcggtaaattaggagaaaaatccgttattcacccgaatgatgatgtcaataaatcccaatcttcaaatgatacttatcctaccgccatgcatattgccgcttataaaaaagtggttgaacatacgttaccttgtgtcagacgtttgcaaaaaacgttagcagaaaaagcagaattatttaaagatgttgtaaaaattggtcgtactcatttaatggacgctacaccattaactttaggccaagagttttcggcgtatgcggcacaacttgctttcggtatcaaggcactggaaaacaccttaccgcatttgcgtgagcttgccttaggtggcacagctgttggtacagggctgaatacacctaaaggctatgatgtaaaagtagcggaatatattgctaaatttacagggttgccttttgttaccgcacaaaataaatttgaagctcttgcaactcatgatgcgattgttgaaactcatggtgccttaaaacagttagcagtttctctttacaaaatcgccaatgatgttcgtttattggcttcaggtccacgctcaggcattggggaaattctcattcctgaaaatgagccgggttcatcaattatgccgggtaaagtaaacccaacgcaatgtgaagcaatgacaatggtttgtgcacaagtactaggtaatgatgtcactatttctttcgcaggtacacaaggtcatttccaattaaatgtgtataaacccgtcatggcatacaatttcttacaatcggcacaattattaggtgatgcttgtgtgtcatttgatgaacattgtgcaatgggtattgagccaaactatccacgtattaagcaacaactggagcaatctttaatgttagttaccgcacttaatacgcatattggttatgaaaatgcagctaaaattgcgaaaactgcacataaaaatggtacaacattgaaagaagaagccatcaatcttgggttggtgagtgcggaacaattcgatgaatgggtacgtccggaagatatggttggcagcttaaaatagttcacttattgaacatttaactaaggcgagatgagttctcgccttattttttactacaatagctttaacttaacattattttttataactgaattggttccaattttgatttttgttccgtagttaaaacatctgttgaaataatatgtaatccggttttgttattcagtcccaaatcagcatggaaataatcaggtaatttgtacattgcacctgttataggatcaacaataagtaacccaattaagcctccaaatacaaagtttccaatataccaaccatcaagtttcgcttctaacagaaaagtttggcttttggcatttttaccttcaggggtaaaagtaatttcatatttttcgcctttgaaatatccggctcctgctggtaagacaacattttgaggtgtttttccggatgtaataacttttccagctctattttttatcacaaagtaggcattactagggtttgattgaattgaaacattataatcgcgtttactcacgatagttgcacaaccggtagcaaacatagcgacaaatgctaatactgataattttcttaatcttttcatggataaatcctcttaaatgtgtaaaatggtaacaattatactaatctgtctattagtgttcgaagttagattttaggtaacaatctatattttgactagaaacgaataagataaattactacctaaattgtgattaaaattacccaatttgtgaggttctcatggcaatgcataataaaattcgcctgatgcgggaagtccgccaatggtctcaagaagaaatggctcataaaatgaatatgtctctaagtggttatgcaaaaattgaacggggcgaaacaaagttgcactatgataaattggttcagattgctcgtatttttaatatgaacttagcggatctgatagatattgataaaggtgtaattttttgtatgaatgagaacagtgattatatttatacaaattatggcaatatgagtgaatcatcgttaattgaaatcgaaaaattaaaactgacgcttgcacataaaaatgagttgcttattcaaaaagaaaaagaaattcaatcacttaaaaagattattaccctgttggaaacttcaaaataaggcatttctctgatgtgtcgttgattggcaagaacaccactttaaaaattacctgttggcgaaatgatatatgttttaattactttgctggatcataatattccgttatgtgttcttttagtgagccggttgtccgaaaaaattcattggctgataaaatagcttaaattttccagcatttcattaattatttaaccttttatctgtttgtctttccctttaaaagtgtcttattttatcaatcatctttgtgaaatttttgagaaaaatttgaaatgatatcaaatgcttctgtaatcattcgcctgttgtaataattgccgactttctttcaaaaattgctctgaatactcaccaaaccattcccgcacttgattaaaacagtctataaacccctgcttgttattatgttcaaagaaatttagactttcttcatagctttgttttagactcttaatcacttccaaattctccgatttgtccataataatatctgcataaagttccgcatcttgagcaaataaacgtccgatcatggctaattcaagacgataaatgggtgaagatagggcaagcaattgtgccaactcaataggttgttttgataaatgcaaaccatttgcaaaggttgaaaaatgacgtaaggcttgtacatacgtcatacttttatcatgttcggttgcatcaacttgataaattttcgctccccacatttgaatttgttccaaaaaccattggtatttttcagggtagcgaccgtcacaacgtactaccacttgctttgccatattggtaatatccggaccaaacattggatgtaatcctaatactgcaccttgatgcacttgtaacattttttccaacggttgacgtttgactgatgttaaatctgttaatagcatattttcggttaaataaggcttcagacggtcaatcacatttaaagtttgtgcaattgggacacaaacaataactacatttgcattttgtaaaattttatccgcactttgccaatcctgtttctctaagacagcaatttgataaccggaagaagacaaataacgagcaaataatgcccctaatttcccctttcctccaacaatgacgattttttttatttcaggatttgctgttttaaaaccgtattgattttctctagtataagattcccgcatcaaacgacgcaaaacatcttcaattaaatccggtgaaacacctaacttttccgcttcattgcgacgagcctgtaacatttcattttcacgttcaggtacataaatcggtaatccatattgatgtttcactttgcctacttttctgactaattctaagcgttgagaaaaaagttgtagtaattcacgatctaagcaatcaatttctgttcttaaattttttaaaacgtccatagctattttcatcttactaatataggttgtacatttattattacaatagttgtaaaaaataacttacaaaataaacatcaaatacgcaactaaattttataaaaaaataccgcactttgcgttctgattaatccgcaatcgtttgcttgtataatttatattatgctattcttagcattatttttagtaaaggaattcttatgcaagataataaacctcaaatagccattgtcatgggatcaaaaagtgactggtcgactatgcaagaaaccgctatcattttagatagcttggatttaccttaccatgttgaagttgtatcggcacatcgcactcccgataaactctttgagtttgcagaaaatgcagaagcaaaaggttataaagtgattattgctggtgccggtggtgccgcacatttacccggtatgattgcagcaaaaactatcgtgcctgtattaggtgtaccagtaaaaagctcaatgttaaatggtgtagatagtttatattctattgtgcaaatgcccaaaggcattcctgtgggaaccttggctatcggatctgccggagctgcaaatgccgctctgttagcctcacaaattctcgctgctttcgatccgcacttagcacaaaaattgcaccaatttcgccaagctcaaactgacagtgttttgaataattccgatccgagagaataaggctttaatttttcattaggtaatgttgagcaatgaataaaaagccgatagttaaaaaatcctatcggctttatgacttggtcagaaaaattaggctttataatttttattcaaagcaaatgtatatcctctcaaacagttgtttaagactttccggtatccatccagctatccctagcataagtcatttggtttcccaagtcattttaattagttgtcttttggcactactaatagttcaatacctttttctctaattttttctctcatttctaaagacaaaccttcatccgtaataattgtatggattttatctaaaccacacacaatattcgggctttttcttccaaatttgctggaatcggctaaaaccacaatttttttcgctgcatcacacattagagaactcactttatagacctcattaaaagtagttagcccaacgtctaaatcaaagccatcagtaccgataaaaagtatatcaaaggttgaaccgataaaagcagattcagcaaaataaccgtgaaaagaggccgatttttcacgaaatgtcccgccggaaattaataaattataaggtttattcagtactaaaatagcattaaagattgttaaactatttgtcattaaagaaagattatcaaactgctttaagtatggaatcatttgtagcacagtactccctgcatcaaaaatgaccgaatttccttcactaataagcgttgctgctttttgcccaatacgttgcttttgttgaatattaattgctgttttttgtgcaatcggtttatcttctttgtcctctttattgattttttcttctcgttcaagaagttcttcatcaattaagacgacacttccataagtacgtaagacttttctatcttcttcaagtgcggttaaatccttacgaattgttgcacccgtcaatttaaaatgagtagccaaaacatctacttccgttcgcccatattttgctaaaaacgctaaaattagctgtcttctttcaaaaggtttcattgttcctccaatttagcaaaaattggagcgaaccaatctatgctaatatagttttagttttgtcatgacatctaaaagtgaagccattctttcatcggcaattgaaaatttttcattttcataattggaattcaccaaaaatgtagttaaattggctgctttggctgcaattaaaccagtaatactatcttcaataacaatacattcttgtttttcaatccctaatttttttactgctctcaaatagacggcaggatgtggtttgccatattcttcatccattgcgctacattgaattgggaagtaatcccacaaatttaagcgatcaaaaatggtcttaattacaactggaggcgatgatgtagcaactgccagtttaatatgattagattttaaaaacgctaataattcatacagccctttcaaggctatacctgtttgtgcaattgcattacagccattttccaaaattgcttcacttaatttttggttggatacggataagttaaattttttaatccaagtttcactcaattcatcgatccgtttacccctagtgaatttttcacactctttctcggtaattgcgataccaaattcagccaataccgcaatttgagcctttgcccattgaggttctgaatcaatcattaccccatccatatcaaagataacactattgatttgcatcctttttctccattatcgcatttttcaatgaaaaaatattcaaaatgaaataaaatttacattgttttttgatcttaacaactatatccggaagatattgctacttttaacgcaaattgtgagcgtttatcagttggaaaaattttttccggaataatttgatcaagaggtaagccaatgacgtcaactaacttttgtggtctggcaaaaacagaaaaacctttcatgtgaagactatccacaacttttttctcttcattaaatgccaagacaatcaccgattttggattaaaacgaccgctgttacgcccaacagtgatttttcctttcttgcttatttctagaaaagcttggttaaaggctctaatttgtagccagcctagaatagattgcaaaagccacattataattgagaatgtaatcagcaatgtaattggatccatttttacctcttaataaaaagccatagagtctgaataatctggctgtttactcatttagaacatcacttgaccgccagtaatattaattgactgtccagtgcaataagccgcttcttcgctggcatagaattttaaaacattcagtacatcttgataatcacaacctcgctttaaaggtactttatcaatataaacttgctccacttcactctccgagataccaagtttagccgcatattgtggaattaaagattggaacatcggcgatttcaataaattgcctaacattaatgaatgaactgtaatgcctttgtcagcaagatctaatgctaaggattgcgttaagccaacaccgccaaattttgccgcactataaccagaattgtacttacttccgactttacccgatttagagttaatttgaatgatacgccctttaatgccatcacgaatcattaaacgggaaaaatgcttggcagttaaaaagtaacccgttagattcacttttactgataaatcaaaatcatttaaattgaaatcccaaatgggtgaagcttttgcagtacctgcgttatagaccaagacatcagcacgaccaaatacacaatccgttacttttgtcaaagcttcaacgcttgattcatcgcccgcatcaacttgcaccccaattgcatttccttcgccttgcttgacgttaatatcagcagctactttttgtgcattttcgccatttaagtcggcaacaacaatacgatagccggcatccgctaaacctttagataaaaatgcccctagtgtttgaccaccaccgacaacgatggctacttttttttcattattcataatatattcctttaactttcaatttgaaatcatttctaatttggacttaatcacgtttaataactaagatggaactttccattaatgtttttggtggaacaccaacaacatgaacacttcccggaaattccgcttcggtcgccccatcaaaacggaaagtaatgtgtccgagtgcggataaattatccgacgctacactgccaatggcggtaatcggatattcaacaccatcaaattcggcaatatcgccaacttgtaaagcgtcgcttaattcagatggattgtgtaagaaacagtaatcttctaaatcggcaggtgcattttgtttgaaagtgattaacatattgtcgtttagtgcatcatgagcaaaattgccgattttagtaaacgttgttttatagataatcgtcatttgaatattccttttgttttacaagcggttggtttgcaaatttaaccgcttgtaaagtgattactgataaatgaatgcagataccgcccatgcaattaatactgtcggtgcaccagtcaaaaaacgactgactaatacagaaggtacgcccactcgcacagtatcttgtttcgcttctgccattgaaagccccacgggaatgaaatcacaagcggcttgagcattgatggcaaaaagtgccggcagggctaaatgtggtggaatgttccctaaaccgatttgtgtccctactaatacaccgataacttgagcaataacagcaccgggacctaagaatggagagagtagtgggaaagaacaaattaacgcaagagtaactaaaccgagtgagctatttgcaagtggtgttaaaccatgagcaattaaatcccccaaaccggaagcaataatgattccaatcaaggcggaaacgaatgccataaacggtaaaatggttttcaggactgtatcaatagtatcacgtccggcttggaaaaagagtgcggcgacagaacccattcccatacctatttttgccaataaaccattactttgttcggtgatttttttacttgaatcatactcttttgcggtagttgatgaagcaattttttcttcagatatgacagaaagggctgcggcatccacatcaattaacgaaatattattttcttttacggcagaaacataaatatcttcaacaataaattctgctaaaggtcctgatttgccggttgcgtgaatattaatagttggaatgcgacgttttgggtaaagcccacaacgtaatacaccaccacagtcaacaattgcaattccaatttcttctgctggcggttcgccttctttaaaaccatctactgcttcccagccagttaattccaccaatttattcacaatagcaggacgagtgcctccggtcatataaagtatttttttgccttcaataataggtaatgttaatggaccaccccagccaccgttacctttttcaatataaactgctttattactcataatgtattcctctacttttcattccgtttaattagtttagtgagatagattcacttctctatctaatgtaattcccattcttttttcaaagaaagctgtggtaaagtccgtaatccaaccacggaagaagttagtgaacatgccgactaataaatagctaacagctaaaggtccaagaggtaatcctaaagtcgttaaaccactggcaatacctaaataaacgaataattcacctgggttgatatgaggaaataagccgttcattgagtggcagctataagatgctgcggcgtagtaacttggtttataacgctctggtaagaagcgtcctaaacttaacgtcataggattgcaaaaaacgaaagtgccaattaccggtaagatcaaataacgtgaaataggattgcctgcacttttctgtgccagtctttctatacgatcttgcccaataaatttaattaaggcattcattacaaccagtaatgagattaatagaggtaaaataccattcatcattccgactaaggtttctccccctttttggaacaaaccgataaaccattctgctccgtgtgtgattgcttcgatcatacgacctccaattttcaaaataaaacatattttttcatctctgcattttagagacatgtaaatagtaagttattttcattttaaaaactgtgaagttgatcaaaaaatcaaaatttatttcaaaataaattattattgtttcggtttgaaatattgattgagtaatttggacggaaagaggcaccttttgttttaaacacataagaatttaagttaagtaaatgcgaaaaattaagcctttttcatcaagcaattgatgatttattcgtcgcagagacgaataaaagtacactggttttaagtaatggtttggaaatggaaaagggcgataaacccaaaccacctcattatcatcatgtcgtgcatgataaaatgatgcaccaagcagtcaaacaacatttttagttagaaaaacaatgactcacacacgatggagggcggattaaatcagcaactcttttttattgatgatattcaaggttatcgtgctgagaaaaaatcagttttcaggcaatctgaaaatactttttgaataaatggtcatagttgaattggaaaatatcctaaaaattaaagtgatgaatttttcaggatatttttattttaaacttgacatttaaaaaatgtcatgataataaaacgtaaaaagtttattatggtaagaagggaatgaagaaaaaatatataactgcaattctgttattaatatcagcatatgcttattcatataggattaatgttatagatgattatgatttaattgataaggaatatatagaattttggaatagagatgaacttataaaacagatagaagtattaacaatagaattattaaacagaggttatgtaacatcgaaaattattgataaagaagagaatttagttattattcctggaaaaatacaaaaagtaatattacaagataattcgacaaaaaatgcaaaattaaaaaaggaattattaaatttaaataaattagagggagagatattaaatattcgtgatattgatgaaatagtatctaaatttaaaaaaataaaagataataatgtaaaaataagggtggaaaatatcaaaggtagtcaagatagtaatataataatcataaatgactttaaacctgcgatatatcctaaaatttctgcagattattctaaaggtattaattcggattcttatcgtggttttaaatatgttgttggatttggtttcgaacaattaataggtatgaatgacgaattaaatgtgaacttttctctattatcagattatagaaatatgagcttgaaatataaaatacctataagaaataatgaagcaacaatacagtatcagtatacgaaagacattttaaatgaagatgtagaaacaatagaaagagaaatattattgaatgtaaatacggatattaataatatagatttaaataattcgataactataaataataaaaggtttaatgtaaggaaaaatacgaatataacaaacaattggttttatgagtttgaaacaagtttagtgtatacaaaattattgaatttaagtggttattatgttcaattaatgttaaaacctaaaataggtataaatattgcggatataagagcatataaaaaaaaggattatgtaattacatcaggtatagattttaatttatattctaaatactatgatttaataacgaatgtgatttataataagaatatgagttcggatagtgtgtatgatcgttatacgagaaaacttaatatatatgggattgataatatcccgttatcaatagcaaagacagataaactcatagttatgaataataaactgaaatatccaatgacaataaacaaaattaatgtaataccatatatcgatgtggcactaggtagtaattttaaagaatattcaactggaatgagcataggttcaaaatttaaatataaacaaacaagtattaatctagaatactcaaggagtaataaaggtaattcagttttaaatttaaatttagggtttgaattttagtgaaaggaaatcttagtgaaaaggagttgttatgtataatgagaaaaaagtattaacaatggtatatttatttgcagtgatatccgctcaagtaaatgcacagaccgtgaaaaatggggacacggaggtagaaaagaaggatggtttcgatataatcaatattaacacgccaaacacaaagggagtttctgttaataacttaaatgaatttaatgttaaagataaagggacagttatcaataacattgagtctactcataaatataagacagttcattttggtgaaatcgatggaaataaaaatataaagactaaagaagcagatatagcagtgttgaatgtgaaggggacgagtaatacaagcttaaattcaactttagaagctgcatcatcaaatccactaaaagtatacatagctaatgaaaatggtataaatgttgatggtggtaaatttgtaaatatcgacaaattggtactgactacaggtgttgttgatgacaatgatatgtcagtgtcggttaaaaaaggtgatgttaatgtttcatcaaaaggaattagcggcgttaaggatatatcgatatatagtgaaaaattagataataaaggtaaaattgctgcagaaaacacaaaaatagtactaggacatagttctataaaaaataatgaaatatcttcattagatgataattatgtgagtgcgagtgatttgggggctatttatgggaatgatatacaaattcagtcgacggggtatacggatattaatgttaacgaattattagcaaaaaataatattaatattaattcaaaaggtaaaattaaaaacaatggagatattatatctggaaataaaatagatataactgctaaatcgcttgaaaataaggggactgtagattttggtaataatacacatgaattaaaatggatagatgctaaaggtaatgtctacactaaagaacaattagaaaaagtgtggaataaaagaatgaaacaaactttaacaccagaatatgcatttctttatttgacgggttctttattaaatcaatgggctactgatgaagaaatggcaaaaaggttaagcccagaggctaatatttttaaaagatttgatgaaactttaaataaatttaatgataaagatataaatacttttttaattagaaaagataaagaaaaagttaaaaataaacataaacaaagagattttgttaataaaggagatatttatgcaactgagatagatgataaaaaaatattagaagcagttgcagtaagtaatgttaaagccaatcaatctattatttcttcaaaaaacattaaaattaatttgactgatgatttattaaatcaagatgctagtatagaagctattgatgaattagatattaaagctaaagctaaaaaattagttaataaaaatagtttatcaaatgatataacattgaatgatggatatgaaaatttatcttgggatttaatggttttacaaaaagatataagagccaattatgatataatttatgaaaaaggcttggtttctgatcaggcagcaagaaaggctaaaatagctgctgtgaataaatcacaaattaaggctaaaaatatgaaattagatgtagataatatagaacttcacgatgatataaatacaggagcatctattaaagcagataaattagaaacaaattctaaaaaaataagtttaaaaggtcaaagtatagaagctaaagaatataatatgaaaactgatgagcttgttttgaataattcaactatttatacagataatatagatattggtgctaaaaatgttaaacttttaagtaaaaaagataaggaaatagtaataaaaacaggtaaagaaaatttaacaaaagaaattatttctagttcaggtatttatgctaagaataatttaaaaattaaatcaaaagaattgcaatcaaaaggttcaattattaaatctgataataaagtagaaattaatgttgaattactagaaaatcttgctgaaaaagttacaaaagattataaatcatcttatgatatttctaaaacatttagaaaaattaaacataacgaaaaaagtgaaagagcggtagctagttttatttatgcaaaagatttagttttaaattctaaaaaaacaaataatgtagggagttatattgtaggtaccgattcaataaactataaatcgggtacaactaagatagatgccttaaagattaataatgaattagacaaaaattatggtgtagataatggtatattaggtataaactataataaagttaagaagatggaagatgaagcagttgggtctatagttttaagtaaaggtgaaataaaagctaagattgataaagagctagaaataattggaagtagccttaaaggtaaaaaaatctttatagaagctagtgatgttaaaataacttctaaagaacttgacaaaacaacagaaactgaatcaagacaattacttgctggggatttaaaaggtggttttgaaaagaatgctactttagataatatatcagcaaaagtagatatggaattatataaaaatgaaaaaatgatagttaaagaaaaaaaacattcaaaatcagaaattgaaggagaaaaagttacaatagtagctaaaaatgaaaattcaataaaaggttctcaaattaatgctaataatttagaacttaaaggaaaaatagttagaatagaagatgatatttctaaaactgaggttgagaagaatacagtaacggtttcagcgactaataaaattgcagtaaatgaaggaaatttagaaagtgataataaattaataattagtaaaactaaagaaaatttaaatactgaaacttctaattcctcaaatattaatgctaaagctaatgtgaaaatagaagcagacaaagtgttagtgaaaggttctaaaattgaaggacaagaagtagaaataaaatctaaagaaaaagttgatatagttaaatctcaaaccaaagaagattataaaaaggattctgaaacagttacattagggtctaatgttaaattagatgctaaatctgttgcaattattcaaaccttaaagaaaatgtatgatgaaaaagacaatctttcaggatatgctttaaatccagtgtcaggatatcaaaagataaaagaatataaggtaatgctggaaaaaaatattgataacattaaagaattagttgctaatgtttcagataaaaaactagatcctgaatctttaggggtaacgatgaatgttgaaaatagtattaaatacaatactaatcatttaacatcttcaaaatttgataataatgaaagtgaaattaaagctgataaagttacaattaaaacagaagagttatcattagaagcatctaagattaaaggaaatgaagttaaaatagaagctgaaaaagtgagtttagaatctgctgagaaaaaagtaaattcaaacgaaacagatgccagtgttcaagtagctatggtacatgaaattataagtcaaaatacattatttaaaggtgattcaactgttcaaaacaaaggaaattataaaacagaacatacttcaagtaaaatagaagcagaaaaaatagatttaaaagctaaagaattaaaattacaaaattctcaaatagaaacaaaagagggtaaagttgaaactgataaattaagtgtatatgataaggcagataaagaaactaaatatggcgttactctagcaggtatgtataatggaggtacaaaaattggggttgggagtgctacagctaaagtagagcatgatcaaaaagttaaaaatgtatctattgtaaaagttgaaaatggtaaagttgatgttaaaaaagaagataaaaagaaagatatagaagtcaatattgatgttaatactcaattgggattaaatgtagatccaagcggtgatgttaagggtaaagcaagtggtggagcaaaaactaagctagattcaaaaggtaaaaaaattcaaggtacaggttatgtaggtgttattggagatttagcttttgaagatggaaaaatcacagatgtaaatgtgagtactgagcttaaaggagatttgacaattacaccagaaaaatatgttgatgaaataaaattaaaagttaataatcgtttatctatagatcatgatggtcaaataagtaatgatttaactggtaatttatctactgttactcaaattaatactgaaaatatcaaaagcaaattaaatgtaggtgtagacggtaatctagttactaaaaatatggatataattcaaggtggaataaaaggaaatgctgctggagaaatagaagcaatagtaaaaataaatgataccgtcgaatctaaattaagattgatggctgaaggtaatgtaattaaggaacatggaaaatacataaaactagattctgaattatcgtcaaatgctaatttgaatgtaaaaggtgcaactaaaaatgtttccggctacattaatttagctaataattcgagcataaaaattaataacgaaaatggcattaaagattattcaatagataataatgttgatggtaatctaaagtctaaaggaagtataggcgaaaatgtttcaggagacatagacataaatttaaaatcggatttatcgaaaaaaatgtctcaaaatataacaactagtaccgctgttatggggaacggaaatctaaaagttgaaggaaaactagaaaatttagatggaaatatgggattaaatctaaatggaaacgtggcaggaaatgaggcaggattacaagagttaacaggaaatgctaaagctgatggaaaattacatgctcatggagtattggaagcgtttagtggggatgtaacattagctggaaatactgaattaaatgcaaaagtaaatgaagcattgaaattaaagggaaatttaagtggtcattctaatattagtgttgagggacagacagatgtagtaggtggcaaaattcaattaaaacctcaagttaatatatcgggagataatgttaataaattaacaacatttgatacgagtactaatttgaatggatacattgaatcgaaagtgaaaaatgagtatgtaagaaacattaaagcgaacctaaatactatattcaaaactaaaaagtttgaggtggagacttttgaatcaagtcttgatagtgaagttagatctaaatataaggatatagaatttaatttagcttcaggagaaagaatatcattaaaagactatattcaacaaaaaatatctaatgataaataaaagtttaaagaaaagaaaatttttaaaacaaattttgatctgacactaaaaagttgaactgctattcaaaggactgattttgatattgtatcggactcagtccttttaattgaatccgttcttcgttgtaatttaatcagttggttatttaatcctcctttcggaggcttgatcaaagagtagttttctgttttataaaattttgggtagtgaataatactcaacgtcatatcaacctaatatcaaaacaacatactgaataaacaaattaaaaggatattcctagtgcttgtttcattatttgttctttgacgaaaccgaatcggttagtggtatttaaacctataccacgtactaactttttcactggattatcgccgttaaagagttcttttagtccctgcattgccactaacattttgactgccgctgttttctgacagcgttcataatgacgcaaatatcggtattcaccaatatccattcttaaagctaaatttttgttaatttcttgtgcaagtataacggcatcttgaaaacctaagttgactccaagtccggctaaggggtgaatagtatgagccgcatctcctactaacacaatgcgatgtttggcaaaactacgtgcataacgtgcagttaatggtataactttgcgttctccacgcacctcgcataatcctaaacgattgtcaaaagctacagataagtttttattaaattcattttcctctgcgtttaagagttcattggcttgttgtggcggtaaagaccaaactattgagcataaattttgttgatgtaaaggcaagaaagctaagatgctgtctttgttaaaaatttgtctagcacaattcttatgcgattcagaagtttttacgttgcaaactaaagcatgatgtccataatcacgaaaaatgagcggaatatctgcttgtttacgcacccaagaatttgctccgtcagcccctacaattaattttgccgataacatctgtccatcatttgtggttaaaattgcattgttttcggtgagtcctaaatgatgcggaagtgcggtaataatttccacatttttttgcatttttaccttttgccaaagttgattttgaatcagatgattttcaataatatgccctaaatgctccagccctaaactttgtgtatcaaattgaatttgtgcaaaactatctttctcccaaacatccattttgtcgtatgccgtcgctctcaaattcaataaagcttgccaaacttccaagttttgcaacattttttcgctggctaaatttattgcactcacacgattactaagttgctcaatcggttctttattaggaaatccttcaattacagcaattttcatagggctatttcgcaagctggcagctaaagccaagcccaccatgcctccaccaataattgcaatatcaaatattttcatcgtcattactccaaataaagataagtttaacaccagcctaacgttgctttagcaaaatactgtcgcaataaagaagattgagcaaatgccatcaagccaaaattacgcccaatttgtagcggtaataaattattggcaaaaatagagactaaaccatcagttaaaccaataatattacgttgatcggggttgcgttgtttcgcatagttttgtaaaacttgatatttcccccaatcttgttgttgtaaataagcttgcgataccacatttgccaaactcattacatcacgaatacctaaattaaatccttgcccggcgaccggatgtaaagtttgacaggcattaccaactaaggcaacacgatcttgaatatgttgtgccgccttatataaatttagagggtaggcaaaacgtttaccacattctttcagttttcccactcgccaaccaaaacgttgttgtaagcggtttaaaaattgctgatcatcaaggtttattatttcttgactatttttgacgcaccaaaccaaagacattaaattgtctttcattggcaataaagcgattggtccttcttcggtaaaacgttcaaaggcacggttttggtgaggttgttgtatcaaaatattactgataatagcagtttgttgatattcacgcacaagctcttgtgtaatacccaccgcacttgctacgttggattgagtaccgtcagctcccaccaataaatgagtgcttaaagtgcggtgatcttctaactgaatgtttacttgctcaacatttcgttcaagagaagaaatagaaacgggggaaaaataatctatattgctacaatcctgcatagctcgcatcattaccgctcccgcctgatttaattcaatgacagcgcccagagccgcaagacaaaattctttagcagaaaactctgcaataccgaaatgccctcggtctgacacatgaatatgtttgataggttcacaaagaggcgttaataattgccacagcgattgcttattcggcaataaaatctgattgaaacgccggcaacttcctgatgataaagcaatacagcgagcatcaaagccaccgtgatgatgctgatgaggaatttgtttttccagtacggctatttttattttaccctgtgtttgatagctgagtgccaatgctaaactcgcaccggtcataccaccaccgacaattacaacatcgtagtgcaagtgcatatttttacccctctttcttcacttaaattattgttgcatcagattttcaatatcctcaatttcttttggtacagcagaggttaaaattttattcccattttcagtaatcaaaatattgtcttcaatgcgaacgccaattcctttatattgttccggtacatttgcctccgtaccgatatataaaccgggttcaacagtcaacaccatgcccgcttctaaagtgcggtctcgttttttactatttcgatctccgttttgcacctcactactgtagcttcctacatcatgcacatcaagtcccaaccaatgccctaatccgtgcatataaaattgacgataactttggttatcaattaaggtttgtacatcgccagctaaaattcccaaacgaactaaaccctccactttaattcttaccacttcatcatttgcctgttgaatactattgcctgccactaataactcaatagcacgtttttgtgcttttaatacaatttcataaatttctcgttgtgcctgagtaaatttaccgttgacaggaaaagtacgagtaatatcgcctgcatacatagcaaattcacaacctgcgtcaataagcaacaaatcaccatcttttaaaatttgatcattttcgttgtaatgtaaaatacaagcgttttcgccaccggctacgatactgttatacgcaacatatctagcaccgaaacgattgaagtgatgtagtatttcactttcgatttcatattcaaagcgattagggcgggtttgttgcattgcgtgaatatgtgccaaagcagaaatttgtcctgcttgttgtaacaaagcaatttcatttgctgatttaaacaaacgcatttcgtccacaagaactgcccaatctaaaacttgtgcaaattgcacagtttttttattcagtatatcttgtaaaaactcagttccccaaggttgttgagctgaatggtaataaagtgcggtgatattttccctcagttgtaaaaactgtgtttcaaattcggcaatgtcataagccaaatccacagacaacgttttcggtgcattttcaatccccaaacgtcttccgttccacgtttccattaagggatctttgggccgcaaaaataaaatactttgtgatttttctgcagttttgattaaaagtaaaatgctatcaggctcattaaagcctgttaaataccaaaaatagctgtcttgtcgaaaaggataatgacaatcctgattacggattttttcctgagaggaaaaaacgatggtaattgaattatcttttaattgtgctaatagtttcttacgacgaaaaacaaactcatcgttaggcatttttgccatataagcaagatccataaatactccttaatgcttaaaaaacacactgaattctagcataaaaaaacaagtcattcgattgattaaaaaacaaagctaatctatctataaacagcaggcaataagaaaacaacgcactttattaattgagcgagtttagctaaatacattgactaatgtaatacggttttctttgtttccgataatggtccgaagtgattaaagaataaaaaggtaatcgttctcacatattcaataatttcttctaatgctttagacaactcctcttgatcatctttttcatcatatccaagttgtccaatagcttgtaaatcatccagtgcttcgccgatttcgcctacctctttatttaaattaggctgatttagccctaatcctaataaaaaatggttggtccattccgacagagcatcagctcgagcaaaaacattgtcttcttccggtaaccaaagctcaaaattaaatttatcaatatcggataaagtgcggtcaattttctgataaatttgttccacttctttcaataaggaagtgggatacgcatgatcatcatttgtaaattgataaagaagatactgccaacgttgatctgtaataccaccgcaaattaaaccggtaagaaaaccatgcaattcagccaccgttaatgcaatatttgcttgtttcagttgttgattaaattccgaataaataagaggtttttctgacatttgatatttccttgaaaaataatataccagtttatcactgtttaacttcagcaaccaagaaacaaagggatttttatgacgaaaattttttgctatggcataataaggacacttttagcttttattataaaataggaaaacacatgtcaaagctcattgaattatccgtatcagggcaagtactacgtttaaattgtcctccagaacaacacgatgctttgcgtcaagcggcacatttattagataatcgtgttatggaaatgagagagcgtaccggtattttacagatggaaaaaatcctctctattgttgcattaaatttaagttttgaactgatgcaggaacaacaaaaaactcaaacaatcgaaaatgtcattaatcaaaagattgctcaactcgaaggatctttggagaatattttggctcaaaaaacaactttttaaacataaatctgtgatctaatcgtgataatttgaaaaatattctagccaataaaaataaattgcgttagtattgcactcaaagattacctgagatgtttgccagcggattaagtccctgagccgatactgaaaacttaatgaattggcgtcctgttgttggtgtgtatgcttgctagccatgcaagaaacctaaaaacaatattagccgattcccttgaaccgtagggttcaaggaccgaacatccgcagcggcatctcggggctattcttagttatccagccaatatattgtcccatgagtatttctaatcaacgtcagcaaatacgacaacttattcgagaaaaaagacaaaaactgaccgcacttgagcaagctcaagccgaacaaaatattgcacaaaaagccttggatgcgattgaaaagtttcgtgcggaacatattgccttgtatctttcttttgatggtgaaatttcaacgaaattactcattgaacaactttggcaacaagaaaaaaaagtttatttgcctgttttacacccattttctcccggaaatttattattcttagctttccaaaaagatacacctatgcactacaataaattcggtattttagaacctaagttgaatgtgcgaaatgtactgcctgtttcacatttagatttgatttttacgcctttagttgcttttgataaggatggaaacagattaggaatggggggaggattttatgatagaaccctacaaaattggcaaaaaaaatcttttgtccctatcggattagctcatcaaattcaagaagtagaacgactccccattgaaagttgggatattcctttagcagagattttaaccggataatgaacgcttaaaacgtttacggcggcgatgaaaattcgccgaagcggtacttttttttattgtatgagtaataggcatcatatcaggcgttttttgtcttgtgcgacgatggtaattcaaaaaataatgaatggaattcaccaataaagcactagctaaaaatagaatgattaattcaccatataactgattaaaaatgtggtttattttacgctgacttgcttgtctatatttcatatcaagagtaatacgtaaaaaaccctcaataccattagatgaataaatcggttcaacaatttgctgaatattcggttgcgtagtattgttcgctttttgatttaagttcaatttatcacgcaaaccgacaaaattcgcactatgtgctaacaatttaccgttagcaccataaacagaagcatcaatcacaaattcttctttcgtaaagtcgttcagttttttggtcaaaaggtccgaattggggttatccgcaaaaagcatggcaaaaagattagcttgctgacgcactaataaattggataagtagttcatttgattaattgttgctaattgtgaccctaatttaaacttattaatcccaaataaaatcaaagacataatagttagacaaagcaaaataatgccgagcaacattccaatttttagtattttttcttttattaagctcaagttattttccctaaaaattattaaataggctagaataagaacaaagaaataatttacaggatcttttatgcaaactcaaaacctagagacaattatctctcattatacgctattcccttccccaattttatcagaaaaacccactgtacttggagaagattacttcattctctatggtaaaaatttaaatttggacagtttattaacttttcaacaaaagtgcggtgaaaattttctgattttagattgttggaatcggttagattacactgttgccttattcaaaagcaattggcaatcgcagtacttaactgttgctcatcaactggaacttgatattgcattattaaattttgatgctcgtttaagtcaagcgggattattagttatggatatggattcgacaattattcaaatggaatgtattgatgaaatagccaaccttgccggtacaggaaaattagtaacctccattactgaacaggctatgcgtggagaacttgattttgaacaaagtttacgtcgtcgagtagaaacgcttcaaggagcacctgaacatattttacagcaagttcgtgatagtttacctttgatgtgcggtttaaccgagatgttggaagtgttacaaaaatatggttggaaaattgccattgcatcaggtggatttacttattttgccgatcatttaaaagaaaaattaaagctggattatgcggtttccaatcacttagcggttgagcatggttttctcactggaaaagtacaaggtgatattgttgatggagcatataaagcggaaacgttaaaatctttagctcaaaaatggaatatagatttaaaaaatacagtagcaattggtgatggtgcaaatgatttagccatgatgaaagtcgcaaatctaggttgtgcttttcatgccaagccaaaagttcaacaacaagcacaagttgtggtaaactttgccgacttaaccgcacttttatgtattttaagtgcaaatgatcggattacaaaaaattaaaattgaggagcatattatgccgtcatttgatattgtttcagaaattactctatatgaaatacgcaatgcagtagaaaatgcaaatcgtgtattaagtacacgttatgattttcgtggtgttgaagctacaattgagttaaatgaaaaagcagaaaccattaaagttacgactgaatcagatttccagttagagcaattaattgaaattctaatcagtgcctgtgttaaacgtgatattcaacataattccttggatattccggctgatagcgagcatagcggtaaattgtatagcaaagaaattaagctaaaacagggtatcgaaacagacatggcaaagaaaatcatcaaattaatcaaagacgcaaaactaaaagttcaaacccaaattcaaggtgagcaagttcgtgtttcaggaaaatcaagagatgatctacaagcgactattcaattagtaaaaaatgcggaattaggtcaaccgttccaatttaacaatttcagagattaatttttatttttcctacagaaaccgccaacaatataattgcacatattattggcgtttttttgtattcaaattattacagtattcttaaacttcaatactagtgtaatttaaagctaataggtactgtaatttggcttggtagcccagcaggtttttgcccaatactgcgtgcactttgaaccgcacttaatgctgccttatccaaatcttctgaacctgaagattttgcaatacttatttgacttaagctcccatcagcaccaatagcaaaactaacagtaacaatcccttgttttcgcatcatttttgcacgttgtggataacgtttatggcgttcaatttcacgacgcaacgcacttttataagcagcaacttcatcagtactatttcctgttccaatcaaattcggattagatgttgttactccacccaagcccatagcctgcgaatttactttatcgtcagaatcaatatctctatcacctttaggtaaatcttttggctgtttttgttttgtacgttccttaggtttcttcttcggtttttccttcggcttatctttgggtttctccggttcttttaattttttctccggctcaggtttaattgttggatctgcaactacctctgttactacaggatccggttcaggctcagctaccggttctggcttagaatcatctacaaccatacccattaacatttccattgagatctcagtaccaatcaaatccgcactatatccatttgcactgtcatctggtttagtaaaccaaaaaaaaccgccaattaatgcactatgaaatacaagcgagaagaaaaaaccaaaccaagaatgatatttcttcattacttacttgccttttctttcatcgttacaatagcaacatttttaatttcgttttttgccataatatctgtcaaggttacgaaatcttggaaagtagatttagcatcgacttttaatgtcactttttgctctttatcccaagtcgcaatttcttgctccagttcttctactgaaatgggcttatcattaaaaaaaatctccccttgctcagttactgtcaataattttgctagatcatcggacttgaaagcaactgtgctacttgctttgggtacattaacttgaattttcccttgagaaataaaagaagctgtaattaacacgatggcaagaagcaccaacataatgtcaataaagggaataatattaatttcatcaaattttttcacattactcaccaatattttgctgactgtttaaggctttccattttagacggttaacttcaactttacgtcctaaaccgttgtaaaataccatagaaggaatcgcaacgagaataccgactgcggttgcttttaaggcaagagataagttaagcatgatagcagctgcatcaatgtctcctcctgagttacctaattcatagaacgttaataaaattccaattaccgtacctaataaaccgacataaggtgcattagaaccaattgttgagataatggtcaaatgacggtttaaatcaatatccaactcatgaatattcgtgtaactttccactttaattttggtcagatacataaaacgttcaacggaaaaccataacataataaaactcattacaccgagtaaacccaaaatgatgtagtcaatataatgatgtaaaaaattgaaaaactgtgacattggataacattccttgctgataaaaattacaaataagttattgagaattaatttcaattagggtgaggattttaacaaattttattgagagatcaagctataatattaaaaagagactttttgagtaccgcacttttccatctgttttttattttagtgaaatttgacgtttttcgttcatactatgataaagcaattagaagaaatgtctaattaaaatactgaaagataagacactagtaattgacatccccctgccttaaggccgggcggatgtcaatttctcaaaaattggctgatgactaattctacgcaccatgcgatgatttcattattctctgccatttgtattgctttttctagtttttcaaaggcttttcgaaatgagagaatctatttaaatctttttttcgcttcagctatcgcttcagctacacgtagtggtgaaactccgccttttgcacaacgtttatccaaacaggattgtaaagataagatttcataaacatcctcctctatggtattactaaattgatggaattcctcaatacttaaatcttctaaacctttatgtactttaatagcataaactactgtttcacccacaatatgatgagaatcacggaaaggtacacctttggcaactaaatagtctgctaattctgttgagttagaatatccctttaatgccgcttcttttgttctttcaacgctaactttaatatcttctaacacaaaagtcgccatatctacacaatcttgccaagtatccaacgcatcaaaaattccttctttgtcttcttgcatatctttattataggcaagaggcaggcctttcactgtcatcaacataccggtcaaagcaccgacaactcttcccactttgcctcgaattaattcacaagcatcgggatttttcttttggggcattaatgaagaaccggaggttactcgatccgacagctccacaaaatcagcctctccactattaaaaatgatcatatcttcagcgaaacgtgaaagatgagccatacttaaagacgcagtggaaagaagttcaataatatgatcacgatcagatacactatccaaactatttctcgttgccatcgcaaaatccagatcttgtgcaagtaaatcacgatcaatggcatacgcagtaccggctaaagcaccactccccaaaggacaagtattcattcgttgataagcgtcttgtaaacgaccataatcacgatccaacatttccacataagccatacaccaatgagcaaatgtgattggttgagcacgttgcaaatgagtataccccggcattactacgtgttgattatgctctgctgtttccactaatttacgttgcaattcacgcacggaatactgtaattcagtaacacgttgtttacaccacatcttaatatctaatgcaacttgatcattacggctacgcccagtatgtagttttttgcctaagttacctactttatcaatcagtttactttcaacccaactatgaatgtcttcagcatcatcttgtaaaatcttttgtggatttgaccgcacttcaattagtagttcactcaatgcgttttcaagaacttgctgctcttgctgagttaaaacatttacggtaaccaatgctttagaccaaccgattgatccctcaatatcttgttcagctaaacgatagtcgaaacgcaatgagtcgttaaaatctttaaaacgtttatctgtcgcttgtgtaaaacgcccaccccaaagtgccataatcacatcctttttctgttattatttgtggataaatttagttctcattatctcacacaaagaaaagtgcggtcaatttaaccttcacaatcccttcttaatattaccgctgactgtcatattgatactaaacgactccactttttgacttgatttccgcttgtgttttctcatcgccatccagtacgacatttttctgcttattcggttaaagttaagagttttgatttaaattatgcgttacattatttaaaattactggaatgtatcatcacatttagatgtttgattcaagcaagaggaccttaatgtaatttatttagatcaatagtgcggtagaatttaagatattatttaataataaagggtgataggtttatcatgaaaaatttccgttggtatttaagttatagggcgggaagatttaaacattattggagaaatgtgcagtgtcaaatttatgtagaatcataaaggttttttttaaagtttttttgtatcgctttaaacaaaataaattaaatcaagcagcaggctatttaacttatagtactacgctggctcttgtgccattgattatggtgtttttttccgtttttgcggcgtttcccgtttttaatgaaataaccggcgagctgaaacaatttatttttactaattttgccccttcaaccggtgatgccgttggagaatatattgatcaatttgtcaataattccaaacaaatgagtgcggttggaattattagtttaattgttgttgctttaatgcttattcattctatcgaccgcactttaaactcaatttggcttgatactagtgtgcgtccggcaatattttcctttgcaatttattggctaattttgacgcttggtccgattgttattgcgacgagtatcggtattagtacttatgtgactaaatttgcaacctatacatttgaacaagatttgggtttatccgtgggtataaaacttcttagtttgatgccgtttttcttgacatggtttatttttaccgtgttgtatatggtagttccaaacaaaaaagtgagtattatacattctgccgccggtgcattaattgcagcagttttctttacattgggtaagcaggcttttacttggtatattacaacttttccgtcttatcagttaatttatggagcaatggcaacgttgccaattatgttactttggattcaactcagttggacagcagttttattgggagctcaactttccgcagtactggcggatatacgttcatttgattgtggtaatattcaaatagaaaaaattaaggaagaaaaatgattgcattaattcaacgtgttagccatgctaaagtggaagtcggacaaaatattgttgggcaaattggacagggattgttggttttactaggtgttgaaaaagacgatgatcgaagtaaagcggataagttggctgaaaaggtgttaaattatcgcattttcaccgatgaaaacggcaagatgaacttaaatttacagcaaatcggtggagaaatattaattgtttcgcaatttacgcttgctgcagatacgcaaaaaggattgagaccgagtttttccaaaggtgctgatcctgagttggctgagaaactttaccaatatttcagtcaaaagtgtgcggagaaagtgcgggtcgcaaacggacaatttgcagccgacatgcaagtgagtttaactaatgatggacctgtaactttttggttaaatgtataatataaaaataccgagtgttatgctcggtatttttatttctatttgaattaaaggaatttttcttttaattcttttgcgacagcaagttgtttttcagtcgcttttgctgtcataggttcacggcagtaacctgcattaacaccttgaagtttaaggatttctttaatagttaaatataaaccgttagccagtataccttcgattaagtcatttgtaacatgttgaatctcaagtgcttcagcaacttttcccgcttttgccaattcaaatatttgtcttgcacgtaaaccatttacattaaatgtactaccaattgcaccatcaacacctaaagagactgctggcaacatcatttcatcaaatcctgcccaaactagatggtttggataggcttttttcaagcgttccaataggtagaaatcaccggcagtaaatttaactcctaatactttgggattggcatagagttcaccgaattgctcaacgcccatattgacacctgttaagaatggaattgagtaaacgatcatattgttgccggtttcagcaataatcgtttcgtaataatgtttgatttcggcaaagctgaatttgtagtagaacggcgtgacggcggataagctgtcgtagcctaattctgttgcatatttacctaactcaacagcctcgtgtaagtttacactaccgacttgagcgattaatgcaacttgatcttttgcttcctctttggcaatacggaaaatttcttttttttctgcagttgagagcataaagttttcgccggtactgcctcctacatataaaccgtcaattttcattttatcaatgttataacgaacgatctcacgtaaacctttttcatttatggaaccgtcttcgttaaaagacactaataatgcactaaaaataccttttaagtttttcatttgtttctcctgatataaaagggattaaatttttatttaatacgttgttctaaaatcacattaactgttttttgtttagtttgtaccgcactttcttcttccgcttgaacaatcaaggtgtaaattaagtccaatacaaaaagttgagctatttttgtaccgatagaatcgccttgtagctgcccttgtcgattaccgttgattaatacataatcagaaaccatagtgataggggagcgtaaattatgtgtaagagcgacggtaacagcaccgtttttcttggcaatattcaatgcttgaacggtttctttggaatagcctgaatgacttataccgataacaatatcacttgagttcattaatgcggcttgcatatacataaaatgattattgcttgttgcatcaacgtgtaatccaatacgcattaatttattttttgcttcttctgcagttaagcctgatgaaccgacaccaaacaggaagattcgttttgatacacgcattaattcaacaactttttcgagttgagcaaaatccagcaaattaacggtttctgaaatgacattatgaatgacattttgcaatttttctgcgatttggcttgttccatcaaattttgatatatccgtttccagtagagaattagattgtcgatcttttgtagccaactcaatcgaaagttgtaatttgaaatcagtaaagcctttaaaacctaatgttcggcaaaaacgaataaaggttgcttctccgacatcgaattgttgtgcaatttccgctaaagagttttgtcccaacaactctggagaagatagaaccgttgtggcaatccgtttctctgtttttgttaggctatcatacaaagcaccaatggtatccaatatattaccgctcgttgccgccataattgagcctcttgttaatgttgtttgtttcttgatcaattagtgatacaggtattttaacgactaatttttttaactcagtagcttgaccatcaacattacagcaaggtttgtgcggttcgtaagggaaaaaaacggcaaacatttttgggcgtaatgttaccgcacttttatgcggaatatcatcaattaactgataatcgtcttgctcattataagcggtacagtctgctaaattcggatattcaacaccatattcaattgtttccgcaccggaaattaatacttgaatatcaatatattgatgatgcaattctgcttttttatcttcagaagccacagtcgttgactccatgacattcatataaatttgatcggttaaatcatgtcgacctgtgctcaaattttctaaatctaatgtattaagacgattgcaaatatcgaccattacttgtggtaagttacgcttaaaatcatctcttgttaaatcaccaaaaatcattttttactcctattattatggggtttgttgcattttcatccaataagccgcaccaattaaacctgcatcggcaccgtatttagccggctccaaaatacagtgataaaattttggcatgtcggttaaatattcttgaacgagggataagtatccctcagctaatccaacgctaccgcctaaaacaaccttttgtacatctaaactaatcaccatatcagcaattaagttagcaatagcttttgctgaggatcgaacaagtgcggttgctttttcatcatttttacggtacaagttgaacacttctttcggattacaaggtttttcccacttattcgcctcacgttcaattgctcgccccgccgcaattgcttcaacacaaccacgacgaccgcaaccacaaattggaccgttcggatctgccaaagtatgcccgatatgaccagctataccatttagcccagtggataattttccatcaagaataattcctccgccaacgccagttgataccgtgataaaaataaaatttcgtaccgcactttggtcttgatcttggtactctgcacaaacagcagcctgtacatcatttagcaagccaatcggtttatctgtatggagagcaatgcttttttgtaaggggaaatcaaccagtccaccgagatttttaggattaagtgcggttaaaataccgttgttgataatgcctgtcgatgcaaccgcaaccgcatcaaactgtcccgaataactttgcataatttgctcgatggcatgatgcaatgcgactgtaggatctgcttgtggcgtgctgatttgctgacggttagatagcttcttttcttcaacaacagcggttgcaatttttgtaccgccaatatcaattgctaagcaacgcatacttttttccttaggtttattaggatttagctgatttaaccgaggtgacaaaccagcttacaatatgttctaagcgagttaatgccgaaccaacagtaacacaatcagcaccaatttcaatggcggctttagccagttttggtgtgttgtagcgaccttccgccatcacataacaaccggcagcttttaaatctttaactaattgatagtccggttcttcgggaatatcaccacctgtatagccggacattgtgcttcctataatatcaaagcccagttgttggcaatataaaccttctttcagatttgagcagtccgccatggctaaacagcccaattcgtgaatttttttcaccgcactttcaatgtcaacaggacgtttgcgatcggtaccgtcaaccgcaataatatccgcacctgccgctgctaagccttcaatatcttgtagaaacggcgtaatccgtacaggactgtcttccaagtctcgttttacaattgcaataattggtacattcacgrscggacgagttgcttttaagttatctacgccttcaatacgcaagcctgcggcaccaccgataatggaggcttgagccatcgctgcaacaatttccggtttatccataggaccgtcatctacgggctggcaagaagcgatcaatccaccttgaatagcggttaaaacttgtttatgtgataatgttgacatataaaactccaaactatgggaataactgaacgttattccttttctttataaatattgcgttaatttacgggttagtacctcgtaaccttttcgattgaaatgtagaccgtcggtacacaaagttaaatctaattttccgtctttacccacaaaatcctgccaagtatcaataaaagttaaacccttagggcagtttttccgcaaataattatttaatgcaataatcggtgggttgtctgttgtggcaatattatttaccggcgttgcctccaataaaaagaattcggattcaggggaaattttgactaaggcttgccaaatatcacagatccaatccaatactttggcgtgagaatactcaggctctttaacaatgtcattcacccctaagaaaataaagacttttttacctaaatagttaatcaattgaggtttgataataacatttaaatattgtctagcactgacacccgaaatacctaggttggcaacacgtttgcctcttagttgaatttttggtgaaatatcactccacatatcaaagagtgagtgtccaactaaggtaatatcagcttgcttttcaaattccgcttttttaacttgataacggttgaaaatatcttgatctgtcagcaattgtcggtccttaatttaacaatattgactaatattggaacgaattatataaaaattgaattttctcgcaatgttatttggtgttttgctccagaaattatttaaatttgtgtgccacgtcacaattctgaaataaaactctataaatatattttaaaatgattttttgcttttagaatatactttcagcaacagtgcttttcccttcatatttttaataggagaacttacgatgaaatttgaaaaactcgctcttgcaactttagcgttgagtatgtctgcctctgtttttgcagcagattatgagctgaaattcggtatggttgcaggtaccagttccaatgagtacaaagcggttgaattttttgcgaaagaagtaaaagaaaagtccgatggtaaaattgaaattgcaattttcccaagtgcacaacttggtgatgaccgtacaatgttaaaacaacttaaagacggttctttagattttacattaggtgaaactgcccgttttcaaatcttcttccctgaagcggaagtgttcgcattgccttatatgcttccaaactttgaaatcagtaaaaaagcattacttgaaaccaacttcggtaaggggttggtccaaaaaattaataaagagttaaatcttgagttattgtctgtagcttacaacggtactcgccaaactacatctaatcgtgcaatcaacagcattgcagatatgaaaggcttaaaattacgtgtaccgaatgcggcaactaatttagcttttgcaaaatatgtaggtgcttctccgacaccaatggcattctcggaagtgtatttggcgttacaaaccaatgctgtagacggtcaggaaaacccattaccaactgtccaagcacagaaattctatgaagtgcaaaaatatttagctttgactaaccacatcttaaacgatcagctttacttggcaagtcgtgaaactttagaggatttaccggaagatttgcaaaaagtagttaaagaggcagctgagaacgcagcagagtatcacactaaattgttcaaagagggtgaaaaaaatttagttgcgtttttcaaagagaaaggtgttactgtaactactccggatgtaaaaccgttccgtgatgcgttaaaaccttactatgatgaatacttaaataaaaatggtgcgttagggaaacaggcaatcgaagaaatttcaactctcattaaaaaataaaaaatgccctttccctagtgagggaaagggatagcttttttgttcggagtatgtatgaaaataatgaacaagttagaagaatggattggcggggcattattccttgcaattttcctgattttgattgcacaaattgttgcacgtcaagttattcatatgccacttatatggtcggaagaattagcacgtttgctgtttgtttatacggcattattggggatcagtatggcggtacgtgcacaacaacacgtctatattgactttattaccaatttaatgccgctgacaatcaaacgtatggcgatgacctttgttcaattattaatttttgtctcaattattctgtttatctacttaggttatggcgtttgggcagacgcaacttttcctatggaagcattaaaagctacctttggaacggaaattacgcaaaaatggctctacgcagggttgccgattattgcatctttgatgttattccgttttttagaagctcaagcagaaaactttagaaacaaagccacttacttgcctgtttcttttttccttgtaagtgcggtcattatttttgcgattttatattttcagccgaagtggtttaaatctctgcgtatttccaactatataaaattcggtaaaaatgccgtttatatcgctttagcggtttggttagtgattatgttcttaggcacgcctgtaggatggtcattatttattgccgctttactttatttttcaatgacacgttggaatatcacttattccgcatcgggtaaattagttgatagcttagacagcttcccgttattgtccgtaccgttttttatcttaaccggtattttgatgaacactggcggtatcactgagcgtatcttccacttcgcaaaaacgttattaggacactataccggtggtatgggacatgtaaatatcggtgccagcttaattttttcgggtatgtcaggatctgctttagcagatgctggcggtttaggtcaattggaaatcaaagcgatgcgtgatgcaggctatgatgacgatatttgcggtggtattactactgcttcctgtatcatcggtccgttagttccgccaagtattgcaatgataatctatggtgttattgctaatgaatccatcgcaaagctatttgtagcaggttttgtacctggcgtgttggttaccatcgcattgatggtcatgaactactatgtttctaaaaaacgtggttaccctaaaacaccaaaggcgagcaaagcagaagtttgtgccgcatttaaagacacattttgggcaattttgacaccgtttttgattattggtggtattttctcaggtttatttacaccgacagaagcggcggtcgttgctgctgcatattccgtaattgtaggaaagtttgtttataatgatttgaatctaaagaatttcctcaaaagctgtgtagaagcagtatctattaccggtgtaaccgcattaatggtaatgacagtcactttcttcggtgacatgattgcccgtgaacaggttgcgatgaaaattgcggaaatttttgttgctgttgcagattcgcctatcacagtgttaattatgatcaatttgcttctcttattcttaggaatgttcattgacgccttggcactacaatttttagtgttgccaatgttgattccaattgcgatgcaatttggtattgatcttgtcttttttggggtcatgactacattaaatatgatgattggtattttaacccctccaatgggaatggcgttatttgtcgttgctcgggtgggtaatatgcctgtaagtgtggtagcaaaaggcgttttacctttcttgataccaatttttatgaccttagtattgattacgattttcccacaaatcattacatttatacctaacttgctaatgctttagcagtaaaactggggattgaaaagatagaagtcggtttatgatcgacttctgaagaaatctatttttcaatgtatatctggataggtatttatttttactcaacttaaataagcaattaagcaataatgttctatattatcattcgataaattaatttatcttaataaaagattaccaatcaatacaaaactcctgtacaatatctcagctttatttttccgcttagcgtgcggctaacgaaaataattttagtaaaagtaaagagcggtggtttttaagattatttttgctagtcgcaaattggaaaatagagcaataagattaacttactaatttataaggaaaatattgtgaatccaattgtaaaacaatttaaatatggtcagcacactgtaacattggaaacaggtgcgattgctcgtcaagctacagctgctgtcatggcgagtatggatgatacctctgtttttgtaaccgttgttgctaaaaaagatgtgaaagaaggtcaagactttttcccgttaaccgttaattatcaagagcgtacttatgccgcaggtcgtattcctggtggtttttttaagcgagaaggtcgtccatccgaaggtgaaacattaattgctcgtttaatcgatcgtccaattcgtccgctctttccggagggatttttcaatgaaattcaaatcattgctacggtagtttctgttaatccgcaaattagtccggatttagtggcaatgattggtgcatcagcagctctttcattgtcaggtgtgccatttaacggtcctatcggtgcggctcgagttggttttattaatgagcaatttgtgttaaatccaaccatgaatgagcaaaagcaaagtcgtttggatcttgtcgttgctggtactgacaaagctgtattgatggttgaatccgaagcggacattttaactgaagagcaaatgttggcggcagttgtttttggtcatcagcaacaacaaattgttattgaggcaattaaagagtttgccgccgaagcaggtaaacctcgttgggattggactgcaccggaagcaaacaccatattgattgaaaaagtaaaatctattgctgagaatcgtttaggtgatgcttatcgtattactgaaaaacaagctcgttatgaacaaattgatttgattaaagcggatgtaattacgcaagttacggcagaagatgaaacaattagcgaaggaaaaattattgatattttcaccgcacttgaaagtcagatcgtacgtggtcgcattttaagtggtgagcctcgaatcgacggtcgtacagtggatactgtacgtgcattggatatttgtaccggcgtgttacctcgcacccatggttctgcgatttttactcgaggtgaaactcaagcgttagccgtagcgacacttggtactgagcgtgatgcacaaattattgatgaattaaccggtgaaaagactgatcacttcttattccattataatttccctccatattctgtgggcgaaacagggatgattggttcgccaaaacgtcgtgaaattggacatggtcgtcttgctaaacgtggtgttgcggcagtgatgcctagcttgtctgaattcccttatgtagtacgtgttgtttctgaaattactgaatctaacggttcttcttcaatggcatcggtatgtggagcctctcttgcattaatggatgcgggcgtaccgattaaagcggcggttgcaggtattgcaatgggattggtgaaagaagaagataattttgtcgtactgtccgatattttaggcgatgaagatcatttaggtgatatggactttaaagttgcaggaactcgtgaaggtgtaaccgcacttcaaatggatattaaaattgaaggcattactgcagaaattatgcaaatagctttgaaccaagctaaaagtgcacgtatgcacattttaggcgtaatggagcaagcaatcccagcaccaagagcagatatttctgattttgcaccacgcatttatacaatgaaaattgatccgaagaaaatcaaagatgtaatcggtaagggcggtgcgacagttcgttctttgactgaagagacaggtacatctattgatattgatgacgacggtacagtaaaaattgccgctgtagataaaaacgccgttcaggaggtgatgtctcgcattgaagatattacagcagaagttgaggcgggcgttgtttataaaggtaaagtaactcgtcttgcggactttggtgcctttgttgctttagtaggtaacaaagaaggtcttgtgcatatttctcaaattgcggaagagcgtgttgagaaagtgagcgattatcttgcaattggtcaagaagtagtagttaaagttttggaaattgatcgtcaaggtcgcatccgtttaactatgaaagagttggcgaaagaccaaactaagaatgaagaaaatcttctgcaatcggaagagggttctccggttcaagagtaaatttgatagagtaacttgaagggcaaattatatttgccctgtactgtatctgattactttcatcaatatagtgttttaaatgtgctatccattgaaatttaatcaataatctttttgtttatcttcattgttatttgaacaatattgaaattttgaatgaagccatttatccagcaaaacaagactcaatataagcaagcaaataaagcttgttgtttttaattaggcatatatttccgttgggtatcgttttgccgaacttgtaaaattgattgacaagtaaataatccatgatgaatgaactcaaacatggattccgtgttgtgaaacgagctttacaacgattaattaacctaaggcaaaagcatattgagctttcctttttacattcgagtatttttaatgactgaaacaacaattacttttaatgatttagggttacctgaattcatccttaatgcagtgtccgaaatgggcttttcaactccttccccaattcaacaggcttgtatcccgcatctattaaatgggcatgatgtgcttggtatggcacaaaccggtagtggaaaaacagcggcattttctttgccattattggcgaaaattgatactaatgaaaaatatccacaaatgttagtaatggcaccaacccgtgagttggctattcaagttgctgatgcttgtgaacagtttgtgaagttttctaaggggatgcgtattgttactctgtacggcgggcaacgttacgatattcaattaagagctttaaaacaaggtgctcaagtggtcgtcggaacaccggggcgtattttagatcatattcgtcgtggtacattggatctgtcaaatttacagtctattgtattagatgaagcggatgaaatgttacgcatgggatttattgatgatgttgaaaccgtcatggcggaacttccggagcaacaccagaccgcacttttctctgcaacgatgcctgctccaattaaacgaattacaaaacgctttatgcacaatccgcaagaagtaaaaattcagtcaacacaacgtactgcaccggatattacgcaaagctgttggtatgttcgcggttttcgtaaaaatgaagcattattgcgtttcttagaagtggaagattttgatgctgcaattatttttactcgaactaaaacggctacattagatgtcactgatttattggaaaaacacgggtttcgtgcagctgcattaaatggagacatgacacagcaattacgtgagcaaacattagatcgtcttcgcaatggtagtcttgatattttggttgctactgatgttgctgctcgaggtttagatgttgaacgcattagtttagttgtcaattatgatattccgctggatgcggagagctatgttcaccgaattgggcgtaccggtagagcggggcgtgcggggcgtgcaattttgtttgttgagccgaaagaacgccgtttattgggtaatattgaacgattaatgaaaaaagcaattgaagaagtggaaatgcctaatcatcttgctttacaagaatgtcgccgtaaaaatttcgtagctaaaatcactaagcaattagaacatcatgatctagaacaatatcgtagcttattggaagatttatttacggcagatcaggatcaggaagacattgccgcagctatgttgatgttattacaaggcaaacaaaaacttattcttcctgaagatccggtgtttgaaaaacattcacgacgtaatgatcgtagagagagaggggagcgtcgaggtaaagaaaatccacgttctgagcgtcatgggtatggtattccgcaaccaatggatttatatcgtattgaagtcggtagatgtgatggtgtcgaggttcgtcatgttgtaggtgcaattgcaaatgaaggggatattcaaagtcgttatattggacatattaaactttatgacacttattcaacgattgaattgccacagggcatgccaaaagaattgttacaagtatttgctaaaacgcgtgtattaaataaacagatgcgtatgtctttcgtaagtgcggtcaattctgaggaagagtttgaagccggctcaggtggtaaacgaaaagggcgttatgaacgtgagtttcgtggtggacgtaaatttaatgaaaaaagtaaccgctctttttctgaacagcgtaaagaacgcagagaaagaaagagataaaagcaaaggggctattacagccccttctttctgataaagcaaataattaataaaaattttattaacgactgcggaaaataatacgacctttactcaaatcataaggtgtcatttcaaccgttactttatctcctgttaaaatacgaatatagtttttacgcatctttcctgaaatatgtgcagttacgacatgaccgttttctaattccacacgaaacatcgtatttggcaaggtttctaaaattgttccctgcatttcaatgcaatcttctttagccatttattcctctaaatatgaatgaaaaaataaaaacttcgggattatactctattaatgagaaagacgaaaagaatttattctattaaagggatattatttttatttagctaatattgaaaaatttatcggattgaaaaattgtatttactgactaaaaagattagtatttgactgaagttatactatattttttattaaaaaggataatctatgacaagaattgcaattattcccgctagggcaggttccaaaggtattaaggacaaaaatctccaattggtaggcggtatttcattggtcggtagagcgattttagctgcacaagaatctggtgtgtttgatcaaattgttgttaattctgatggtgagaatattctcaatgaggcggaaaggtatggtgcgaaaacatttttacgtccttctgagctggcacaaagtgatacgagaacgatagatgttattttacattatttgaatgaattaaagattgaaaaaggaagtgttactcatcttcaacctacctctcctttaagaagcggaatagatattcggaatgcaatggaaattttttcaggagggtgtaaatcagttatatcagcttgtgaatgtgaacatcatccttataaatctttcattatagaaaataatgagattattccacatagagaaatcagtgattttgaagcaccccgtcagcaattacctaaagcatatcgagcaaatggtgctatctatattaatgatattgaagcactattaaagaacaaatatttttttattcctccaataaaattctattttatgccaactcattgctctgttgatattgataatacgctggctctgcaaattgcagaaaaattaattcaaaatcaatattagaggttatatttttaaggataaaaatcagcgagatgtgtcgattattcgctatgctaaaattgtgctgtgttagcaattttcaaactttgatttatatttggaaaacatgaacattctcattacagggggagccggatttatcggctctgcgcttattcgttatctactgactgaaactgaacatactatcattaatgtggataaattaacctatgcagccaaccttgatagcttacaaagtgcggtactcaatccacgttatttttttgagcaagctgatattgttgatcaacctgtgataactcaaatatttgagcaatatcagcctgatgtagtaattcatttggcggcagaaagtcatgtagatcgctcaattgcagcaagtgctgaatttattcaaaccaatattgtagggacatttgctttgcttgaggttactcgtcattattggcttaaattgcctgcaaataagaaagagcggttcgtttttcagcatatttctactgatgaagtttatggtgatttaattgactctgaacaggcttctactgaaagtagcccttatcaaccaagcagtccctattcggcttcgaaagcagcttcggatcatttagtaagagcatggtatcgtacctacggtttacctattctaattacgcattgtgctaataattatggaccattccaacattcggaaaaattaattccacgtatgattttaaatgcagtgcaagggaaacctttgcctatttatggagatggtttgcaaattcgggattggttatttgtagaagatcatgtacgggctttatataaagtattacaaaaaggaaaaatcggagagagttataatattagtgcaaattgtgcaaaaaccaatctagaagtggtgcagacaatttgcgatttattagaacagctagtaccaaataaacctaaaggaataaagcaatatcatgagttgattattcatgtcgaggatcgtcttggtcatgataagcgttatgccattgatgcttacaaaatccaaacgtctttgggctggacacctttacaagattttaccgccggcctacgtaaaaccgttcaatggtatttgaacaatggaaattgaagaaatggttaagactgttagttaagcagagtagtgatacacacaacgacaggtttaatatttcgtatgcagtatgtaaaatagctaatcattaagaggtatatacaaggtttaaataaaaaacgttacataaaaattaaacaaaaaattaacaaaagtgtgatttttgtcatatttttgtaacattaggtttattttttcttctatttttgtttacaattcacatcgcatttatcgttgcaattatatcttataatttatttactggagtaagttttatggtcctctttttgagtatctttcctatcgttttattaatttatttaatggtaaaacgtaacgcattaccttcttatttggcattaccttggattgccgctgttgtattaattattcagttagttttcttcggtacagatattaagattgtgagtgcaaatattgcatctgcacttgtagcagttcaaacacctatcactgttattttaggtgctattttattcaatcgtttctctgaagtatcaggtgcgacgaatatattacgtaaatggcttggtactattaacccaaatccggtggcacaattgatgatcatcggttgggcgtttgcttttatgattgaaggggctagtggttttggaacgccggcagcgattgccgcacctattcttgtcggtctaggtttccctgcgattaaagtagctgttttgacacttattatgaactctgtgcctgtatcattcggtgcggtaggtacaccaacttggtttggttttggtcctcttcatttgggcgacggtcaaattttggaaatcggtgctatgacagcattaattcacgctttcgctgcattggtgattcctttaattgccttaagtttcgttgtaagcgtcaaagaaattcgtcgaaatattatctatgtttatttaagtgtatttgcttgtgttattccatatattttattggcacaagtaaactatgaattcccgtcattagttggtggtgcaatagggttacttatttcaattctacttgctaataaaggtattggcttggctaaggttgaaaataatattgaagctgcggttccttttaatgacgtagtgaaagcattgtttcctaccgcacttttaattgctattttgattatcactcgcctccaacagttaccgttcaaagcgatgatgaacgatgcgacaacttggtttgcggttcaattgggttcgttagggcgttttgaaatcagccatggtttaattttcagcctgaaagacattttcggtacatcaattaattccagctataaattattgtatgtgccggcactgattccatttgttgtaacagtattaattgctattccggtatttaaagtatcggcagcaaatacaaaagatattttcgttaccagcttccaacaaactaaaaatccattctttgcacttgtcggagcattgattatggtgaatttaatgttagtgggtggagatggttcaatggtgaaaattatcggtaagagtttcgctgctgcaacaggagagtattggactgtcttctctgcttatttaggtgctgtcggagcatttttctctggatccaatacagtatctaacctaacatttggtagtgttcagttatcaactgcagaattaaccggcttatcaacttcattaattcttgcgttacaatctgtcggtggtgcaatgggtaatatggtatgtattaataatattgttgcagtaaattcagtattgaatatccaaaaccaagaaggggcaattattaagaaaacagttattccaatggtaatatatggtattattgccgcactggttgcattgtttgttatcccgatttttttctaaataatgtatacttttggtaagcagtattctttgatgctgcttacttttatttattttaaattgaaatattggagttcttatgaatgtcaatttttatgtcacttgtattgctgatgtggtgaaggcaggcgtggcaaaaaatacagtattgttgttagagaaactaggttgcaagattatcttcttggaaaagcaaggatgttgtggtcagcctgcaatgaatagtggctatacaaagcaagcattggaaggaatgaagaatttagtatcaacttttgaggtaaatgattatccaattgttgcaccagcaggatcttgtgtttatgcaattaaaacttatcctgagcaattttctcgtttcggtgaaactgaatgggcagaaagagctcaaaaagtcgctgatcggtttcatgatcttactgattttattgtaaataaattaaaagtaactaatgttggtgcaaaattaacaggtaaggcggtttatcatccatcttgtagcttatctcgtaaattgggtattgtgaatgaacctttaacacttttacaaaatgtaaaaggattggagcttttacctattactaaccagcaaacttgctgcggattcggtggtacattttcggtaaaaatggcagaaatctccggagaaatggtcactgaaaaagttgagcatattacagaagttgaacctgagtatttaattggtgctgatgtgagttgcttaattaatattggtggaagattgaaccgagaaggcaaaaagattaaagtcatgcacattgctgaagtattaatgcaggaggataaataagatgtcactaaaaaccagtaatcttgcatttaaacagcgtgtggacaatcaaatccataatgaaatgatgcgtaaagcggtagttaaagctcaagaaactatcggtgctaaccgtcaaaaaatggttgatgaattggggcattgggaagaatggcgtgatttagccaaacaaattcgtaatcatgttttagcaaatttagatgcttacttatatcaattaagcgagaaagttcagcaaaatggtggaaaagtttactttgctgaaaccgctgaagaagctactcaatatattcgtcaagttgcgttagaaaaaaatgctaaaacaattgttaaatcaaaatccatggtaactgaggaaatcggtttaaatgaagtgcttgaaaaggaaggcatgaaagtcgttgaaactgatttaggcgaatatttattacaaattgttggagataaaccttctcatattgttgtacctgctattcataaagatcgtcatagaattcgccaagaattacatgatgccttaggttataaaggaacggaacaaccggaagaaatgaatgcttttgtgcgtaaaacattgcgtaaagatttccttgaagctgatattggtatttccggttgtaattttgctgttgctgaaacaggctcggtatgtttggttactaatgaaggaaatctgcgtttagctacaacagtaccgaaaacccatattgcagtaatgggtatggagcgtttagcaccaaccttccaagaagtagatgtattaatcaccatgcttgctcgtagtgcggtaggtgcaaaattaacggcttataatacatggttgacaggtcctcgtcttgaaggcgaaaccgatggtccagaagattttcatttggttattgtggacaatggtcgttcatctattttggaaagtgaatttaaggaagtattacgttgtattcgttgtggtgcttgcttaaacacttgtcctgcatatcgtcaaattgggggacatggttatggttctatttatccgggtccaattggatcggtaatatctcctttattgggaggttatgaagaatttaaagaattaccttatgcttgttctctttgtactgcctgtaactcagtttgtccggttaaaattccattggcacaactcatctcaaaacatcgtgaacacattgcacaagctggtatgacaccaatgttagaacggttgtctatttttggctttactttagcaaactcaaatccgacgttatggaaaataggtgtaaaaattggtgctaaagtggcggctaaagtgattaaaaacggtaaagcaccaattgaggttggagcgttggcagagtggactaaagctcgtgatttaccaacaccagatggcgagagtttccgtcaatggttccaaaatagaggtaaaaattaatggatttacaaaatcgtgataactttttaaataaattggctaccaaaatgggcagacctcgccaattcattcctgagcctatgcctgagttggtcaataattatccgacaacgcgtttaactgagttgagcaaaaccgacttagttgatgagtttgtgcgttttgctaaagtgatgatggcggatgttattgaaacaagtgaagctgaactaaaccgcactttactggaagtttgcgagaaatatggtggcggtagtgttattttaaataatgacaaaagattagctgatttgggtattttgcaatctgtccaagaaaaatacgatagttatatttgggatttaaatcaaacggaagaaaattttgcccaagcagaaaaagctaatattggtattgtgtatggtgagtatgggttggcagaatccggtggcattgttttattttcggataaagattttggccgttcagtgagtttattaccggaaaaatctattgtggttttacgtaaaagcactgttttaccacgagttgcacaattggctaagattttacatgaaaaggcacaacgaggagaaaggatgccttcttgtataaatattatttcgggaccgagtgctacagcagatattgagttaattaaagtcgttggtgtacatggaccggtacataaaatttatattgttattgatgacttataattgataattaaatcgttaaaaaaatgaccgcacttatgttgaagtgcggtcatttcttatttgatttataggttatggcaacacattacttttaagccattgttcaaattcgttattgttcataaaacctgttatacgagcttgttctatttcctttcctgattgatcaaagaaaatgatagtcggcaatcccaaaacagtcagttgcttcatgagttcagtattgtccgaactgtttttggtcatatctacttgtaacagtaagatatgctcaaataaaggctgtacatttgaagcactgaacgtatatttttcaaactctttgcaggcaacgcaccaatcagcataaagatccaacatggcaaccgatcttggattattagcaagaacttgttgcaattctgcataattttgaatgcgttggaattgagaatgagagggttgttgttgaactgcgttttgttcgtgattccaatttgaattgagcaaaaaaagtgcggtaaaaacaaaggcgataatccaacctaaccagttttttcttaattgaataaaaaaccagacaatgaaagcaaacaaccagcttgcccataaataatcactatattcaggtaaaacacgagaaagtaggaaaataggtaacagtaacatgacgaaaccgaaagcggctttgaccttttccatccaaacacctgactttggtagaattttgttgccaaacaaagtaattaacatcagaggaatgcccatgcctaaggctaataagtatagtgtaaatgctccagttgtgagatcgcctgtttgtgccacataaagcaatgcacctgataatggtgcggaagtacagggagaggcaacaagacctgcaatcattcccatcacaaaaacaccgccaaaagcaccgctcttttgctgttggctgagtaaggtgagtttagtttgtagcgagcttggcagttgtagagtaaagactccaaacatggataatgctaatagaataaaaataacggatagactgactagtacgtaaggactttgcagtgctatttgaaatggtaatccgattgccgctacaattaatcccaatgatgtataggtgagtgccataccttgcacataagcaaagcttaaccccaatgctcgtaaactattcggtctttgatttgcaccgataataatcgctgacaataagggaagcataggtaagacgcaaggagtaaatgcaagccctaagcctaacaagaaaaaacctaatggtgcgtatttgttgtttaataagtttgcagcaagttgattttgttcagggtgttgcatggcagtttttcccgcaacacttaacagatctttgttaatagagatttcttgagtttcaggcggataacaaagtcctttggtacaaccttgataggtaatgagtgctttattaaaagaactatccgttggaagattgatggatagatctaattgatggcgataaatctcagtttctccaaaaaattcatcttgatgtagctcagcggtagggaaatgaagattctcaatagaaacacgttgatttttgttatcatcattcactaattcaatgctgatttcttttttatacagataatagttttcagcgatagcccaatgaagatcaagtttttttccttcttgttgaccactgaattgaaatgcttcatggctttttaaaaattgtgtttttttaccgaaaatgtttccttgtgcttgagacgcaaaaaaaagtgcggtgaaaaaaatataaaaaatagttaaaatttttttcattcaaatgatccctttctaaatagtttaatcgttcaatttatgcagggcgacataatatccgtggcatcagattaaaacaagcgttttatgatctacgtcatgaaatctagttgtatggaaaaaattatctcttttcacttgttacgataatgttgcaattatacaataagccccgaactgaattggattatattctaggaataaagtatgaacataccgcaaattttgattgttgaagatgaagtgattactagaaatatgttaaaaagtatctttgaggctgaaggttataatacgctggaggcggctgatggtaatcaaatgcatcgtatacttgctacatgtgaaattaacttagtgattatggatattaatttaccggggaaaaatggtttaatgttggcacgtgaattgcgtgaaaatacaaatacagcattaatgtttttaaccggtcgagataatgaagtagataagattttaggtttggaaatcggtgcggatgattatattactaaaccgtttaatccccgagaattgactattcgtgcaagaaatcttttacagcgtacgatgcaagaaatacctaaatctggcaccagtcaggtagaacagtatagattcaatggttggacattagatttaaattcacgttctttaattaatcctgacggagaagaatataaattacctcgtagtgaatttcgagcaatgttgcatttttgtgaaaacccaaagaaaattcaaactcgtgaagagctattgagaaaaatgacgggaagggaattaaaaccacaagatcgtacagtagatgtaacaattcgtcgtattcgaaaacattttgaagatcatgcagatactccggaaattattactactgtccatggtgaaggttatcgtttctgtggtgaattagaagaaaactaattaatttgaacagggtaaaaagtgtcatccttttggtattttttgtattggtttgtacactgccctttttctaaaaatgaattgaaaatagatctcactactttcaatactttttctagtctaatattttgataagaaaagcatttttaagtaayggaaatctcttaaaaataataagtcaaagagttttattttttgtttctcgtaaggcttgtaaaatatttttcattgcgagatctaatggagcaactaggcgtagcctttcccctgttttgggatgttcaaaacaaatagcaaaagcatgcaagaataaacggtttaagccaagtgcggtcatttgttgatcaaagtttttatcaccatatttatcatcaagtgcgataggatgacctgcgtattgggtatgtacacgaatttgatgagttcttcctgtaataggagatgccttaactaaagtagcattattataacgttcttcaacgctaaactttgtttctgaaggcttaccttgttcacttacttttacaattcgttcgccactcgtaagttcatttttcaacaatggtgcttgtatcatcttacaatgagattgccaatgaccacgaactaatgccagatattctttttgtatggttttttcacgtagttgctcatgtaggctacgtaaagcagatcgtttctttgcaataagcaatatacctgaagtatctctgtccaagcggtgtactaattctaaaaaacgtgcttcagggcgtaatgtacgtaatgcttctattgctccaaaatttaatccgctaccgccatgtactgcaaggcctgaaggcttgtttaacactaataaataattgtcttcaaagataatttgttgttccagctgtgcgactttattcaatttttttgaaataggggtatgttctttttccgcaatacgaaccggtggaattctaacaatatcgccactttgtagcttatactcaggtttaattctgcctttgttgacccttacttcacctttacgcaaaattcgataaatcaaacttttgggtacgcttttcaattttgccaacaaaaaattatcaatacgctgtccactttcatcttcattgattgttagtatttttacactttggtttatgattttttcattaatatgtgtcatttttaaattttttcagcttatcaaattgttacgtatcatagcataaaaataggaattaccttgctaaaatttatttatcagtagataatagagcctatttttgggtaggtaaaatactcaaaactaaataagtcatcattgatcattttttaatgctgcgaatggcgtaagacattaatatatgaagtgatttcttggtagattaaagtaaacgacagcttgcaaaattaaacatttcaataattttgtttgtattaagaaagctattttaacacccgtcttaataacgcattcaatgcatccggcaactgacagtcgagagacaggcattttgtgacagataagaggtagattgcgaagcaaagagcggttattttaatgctaattttgataataaaatttagagaaaatttagacaatgaaaagaatgttgattaatgcaactcaaaaagaggagttgcgtgttgctttagttgatgggcaacgtttatttgatttggatattgaaaatcctggacatgaacaaaaaaaagcaaatatttacaagggtcgtattactcgtgttgaaccgagtttggaagccgcatttgttgattatggtgcagaaagacatggttttttacctttaaaagagattgcacgggagtattttccggatgattacgtttatcaaggtcgtccgaatattcgagatattttatctgaggggcaagaagttattgttcaggtcaataaagaagaacgcggtaacaaaggagctgccttaacaacctttgtgtctttggctggaagttatttagtcattatgcctaataatcctcgtgcaggtggaatttcacgccgtattgaaggggatgaacgtttagaattaaaagaggcattaagctctctggatgtgcctgaaggcgttggcttaattgttcgtactgccggtgtcggtaaatcacctgaagaattacagtgggatttaaaagtcttgttacatcactgggaagcgattaaacaagcctctcaaagtcgtcctgccccctttttaattcatcaagaaagtgatgtgattgttcgtgctattcgtgattatttacgccgtgatattggcgaaatattaattgatagcccgaaagtgtatgagaaagcgaaagcacatattaaattagtgcgtcccgattttattaaccgagttaaactttatcaaggtgaagttcctctgtttagccattatcaaattgaatcacaaattgaatctgcgttccagcgggaagtaagattgccttccggcggttccattgttattgatgctacagaggcattaaccgcaattgatattaactcggctcgttctacacgggggggtgatattgaggaaacggctttaaatacaaatttagaagcagcggatgagattgctcgtcaattacgtttacgtgatttaggcgggttaattgttattgattttattgatatgacaccggtacgtcatcaacgtgaagttgaaaatcgtatgcgagaagctgttcgtcaggatcgtgctagaattcaaattagccgtatttcacgttttggcttactggaaatgtcacgtcagcgtttaagtccttcattgggtgaatcaagtcatcatgtttgccctcgttgtcagggaacgggaaaaatacgtgataatgaatctttatcattgtctattttacgtttacttgaggaagaggcattaaaagaaaataccaaacaagttcatactattgttcctgttcaaattgcttcttatttattgaatgaaaaacggaaagcgatccatagtattgagaaacgtcataatgttgatattgtggtagctccgaatgaagccatggaaaccccgcactttagcgtttttcgtgttcgtgaaggtgaagaaataaatgagttaagttataacttagctaagttgcatgaaatgaatgatgagacttatgttgttgaggaagcttttatttctcgtcaccttgaaaattcagcagcaacagtggaaagtgcagtcgagaatgcggcggtttcattagctattgaaactccggcaccaatgccacaagaaagaaaacaagagagagaatccttattgagacgtattattgaggggattaaaaacttgtttgctgataattcaagtaaaaataaaaaaaacaaaaatactcgtcagaataaaaatgctcgtcataatcgtcgtaaccaagatcgtcgttctagccgtcgtattcgtcaagagcatgagattaaatctgatgaaaataataaattagatacacagcatgctcattatactgaacgttattctaagcatgctaagaaaggcgttgatgatccgcaaattcagacaaagaaagcgggtgagttggaaattcacacaaaagatgatgagactattgaaacaattcagcctcgtcgccaacgtcgtgatttgcgtaagaaagttagagttgaggaaaatttagttgatacgacaaatttgggagcaactgaagaacacgttgaaaatgaaaaaacaacagagcctgttacaagtttagaacaagcggttttacagacagaaaatgagaaaactcatgaacgtcaagataataactatcgtcatcgacgcttacctcgtcatttaagagtgaataatcaaagacgtcgtcgtaatgtagagttgaaatctgcgatgcctctatttgctgcggtagcatctccggagttagcgagtgggaaagtttgggttgatgttaatgtagttaattcaaaaaataacaattttttatctgtagatgaattactaaaacagcaatatcaacaagaggaaattgaagttgttattcctgctagtgaaatcttgatggatactcaatctgatgatattaagcctttaagtaactttgttagccaaccagcaaatgaagcagttgaaaagaaagttcaagaaaccttgcaacgtttaacccaagaggtggttgacgaatcatcaacaatcgaacgcacagaggtagatactaatacttctgtacctgagtttgtacgtgaatatcagtttaacggacgattggggacaatttctgcggttatgcatacgaaagcagaaatgacacttgccaagtcaagtgatgagccaatgcagcctttctcaatcgttgaatggcaagattctcgttattatttctatggtagaggagcggcaggacatcattgtgcaatcagccatgtttattctgaacctgctaatactaaaatagaataaatattttacatgaatgaaaattccacgcttgaatggaacatgagaaaatcatggacaatacaggcgtggatttttgtttttataaagtcataaaataggtataacaaagaaaaatctatagaataactttcttggttctgatggaaaatatcgtaaaacttctttttgttttttcgcaagtgagtatcggcttaaaacactctgtcataggtacattgtagcagagaagagtttgccatagtttagaaattttgaaaatgtttcaacacattgcaggataggggttaaatggtsccccctaccggacttgaaccagtgaccaagcgattatgagtcgcctgctctaaccaactgagctaaagggggacaggtcgtggattatattgaataaaaataataaagtctataaaaaggagattaaaagcttaaaattcattcaatctcttgatttcaactattaatgtgcctcatcccaattatcacccacaccaatatccacaattaatgggactgataaatgtgccgcattttccattaaagacttaattaatgcagaatattcatctaccttattttctttcacttcaaataccaattcatcatgaacctgcatgatcatttgaatatcattttttttgatttcgttatgaatagcaatcatagctaatttaataatatctgccgcagtaccctgcattggtgcatttatcgccactcgttcagctcctttacggcgtattgcattagatgaattgatttcaggcaaatatagacggcgtccaaataatgtttctacatagccctgctcttttgctttttctcgaatatcaaccataaaagtttgcactcccggataacgttggaaatatagatccatatatttttgagcatttgcccgtgaaatgccaagttgattagataaaccaaaagaactcattccataaatcaagccaaagttaattgcttttgcacttcgacgttgttcacttgttacttcatttaatggaataccgaaaatctcagctgccgtagaacgatgaatatcttttccctcattaaatgccgtaatcaaaccattatcttgagataaatgtgccataattcgtaattcaatttgtgaatagtctgcggcaataattttataccccttacgtgcaataaaggcttggcgaatacaacgaccttcttcatttttaatcggaatattttgtaaattgggatcgctggaagataaacgtcccgttgctgttactgcttgatgataagatgtatgcactcgtccggtttttttgttcaccattgaaggcaatttatcagtgtaagtagattttaattttgctaatccacgatgttccatcaataatttaggcacaatatgtccctgttgagctagcgtttccaatacatcttcatttgttgaaggtgcaccttttggggtttttgcaatgataggtaaggctaatttagtaaagagaatttcttgtagttgtttggttgaagctaaattaaattctgctcccgcttcttgataaacttgttgctcaagtgcggtcaatcttctcgcaattttttcagattgctttaacaatgcctgactatcaattagtacaccattgcgttccatctttgataatacttttaccaaaggcaactcaatatcattaaataccttcactaaacttggcgattgttgtaattcttgccagaggacttgatgtaatttcattgtaatatccgcatcttcagcagcatattctgtcgcttgagcaatggcaattttatcaaacgttacttgtttttttcctttaccggcaatactttcaaattcaataacttgatgtcctaaatatcgttccgataaggcacccatattatgtcgtcctgtgctgtcaagcacataggattgtagcatcgtatcaaaacagacaccgtttaattgaatatgatgattggcaaaaatagttaaatcatatttaatattttgtccaactttttgaatagacggattttctagcaacggctttaattgtgctagacacgtctctttatttaattgattttttacaagctcaaattgttcagcattttgttctgattcagtgaataaatctgtttgtgtcatttcttttacagcttgtttatgagccagaggaatatagcaagcctcgctgttggtcagtgcaaaggaaataccgacaagattagcacgcataggatctaaagcatcggtttccgtatcaacagcaataagatctgcctgttgaagtttttccagccaactatttaatttctcttgagtatcaatagtttcatatgaagtgcggtcgattttaatcgtttttttgaccgcacttttcgactcagaggcactatttgtttgagttttatcaagtttaatttcttgctgagttgctttggtaagtgagctttcaccgcttatcacttcgtttagccaacgtttaaattcataacgagcaaagtattcaatcaattgatcttggttattttgccctaacacgagttgatccggtgtaatatctaactcaacgttggtttttattgttgctaaaaggtaagataaatccgcatctgccttggcggaggatagtttctccccgagtttttttgctcctcgaattgataatccagccactttttctaaatttgcataaatttccgccatactcccaatgccttgcaacaatcccaatgctgttttttcaccgacaccgctaactcccggaatattatcggagctgtcgcccattagtgctaaataatcaacaattaattcaggcggaataccatatttgtctattacaccatctctatccagtaaactgttattcatggtattgatcaacataatattatcatcaaccaattgtgccatatctttgtcaccggtgctaattagaacgttttttccctgctgagaggcctgaaccgctaatgtaccgattacatcatcagcctcgacaccttcaacagacaacagcggaattcctagtgctttgataatattgtgtaatggctgaatttgttgacgtaaatcatctggcatagggggacgatgggatttatattgttcaaatatttcatcacggaacgtttttccctttgcatcaaatacaaccgctatatgggtcggttgaacctgagcaattaaactttttagcatattcaatacgccatacattgcacctgtcggttcgccaagagaatttgttaatggaggaaaagcatagaatgcacgatataaataagaagaaccatctacaagaacaagcggattttcagcaattttagccataatagaataatctcaaataacacaaagagcggttattatagagcaaatttttgagggaggcgaatttgaaaccggaataaacaagactgaaaagaatatattttaagcaatgcaaaataaatccttagacttacgcaacttaaagcaatacaatttcccatcaattttgtcgatgtttttaaccgcacttttaaaccaaaagatcttatgaaactcaatgctcaacaacaacaagccgtagaatacacacaaggtccttgcttagttttagccggtgccggctccggtaaaactcgggttattattaataaaattgcttatttaattgaacattgtggctacttaccaaaacaaattgctgctgttacatttactaacaaagcggctagagaaatgaaagatcgtgttgcacattcaattggtaaagaaaaaacaagaggtctgcttgtttcaacttttcacactttaggttttgacattattaaacaagaatacaaacatctcggttttaaagccaatatgaccttatttgatgaatatgatcaaatggcattattaaaagagattacggcagatctattaaaagaagataaggagctattgcaagagacagtttcggcgatctctcgttggaaaaatgatctgattcttcctaaacaagcgttcactcaagtaagagacagtaagcaacaaacttttgccaagtgttatgagcgttacaataatcaaattcgtgcctacaatgcattagattttgacgatttaattatgttgcccactttattatttctccaaaatcaagaagtgcggtctaaatggcaagaaaaaattcgttatttattagttgatgaatatcaagatactaatacaagtcaatatgaattagtgaagttattagtcggtcaacatactcactttactgtagttggtgatgatgatcagtctatttactcatggcgaggtgcacaaccgcaaaatatggctaggttaaaaaatgattttccacaattacaagttattaaactggaacaaaattatcgttctaaccagcgtattttgcattgtgccaacatcttaattgcaaataatgatcatgtatttgaaaaacgtttattttctactttagagcaaggtgaaaaactacaagttctggaggcaaaaaatgaggagcatgaagcggagctggtcgttggagaattaatcacccatcgttttatgtataaaaccaattatcgtgattatgcaatattgtatagaggaaatcatcaatcaagactattcgagaaagtcttaatgcaaaatcgaattccatataaaatctcagggggaacttcttttttctctcgagcagagattaaagatatgatggcttatttacgtgtactgataaatcaagatgatgatgcggctttattacgtattattaatacacccaaacgagaaataggctccgttactttggcaaaagttggaaaacttgctcaagaaaaacatattagcctttttgacgctatttttgattttgacttaattcaccaactcaatcccaaatcctataatgccttacaaggctttgcatattggattgtcgaactcaatgacgaaattcaacgctcagagcctgagcaagcaatcaaacgaatgttggcacagttacattatgaagaatatttatatgaacatgccaacaaccctaaaattgcagaaatgcaaagcaaaaatgtagccacgttatttgaatgggttgcagttatgctaaaaggagatgagttcaatgaacctatgtctcttagtcaggttgtcagccatctgacgttacgagatatgttggaacgcaatgaaactgatgaagaaagtaatcaagtgcaattgatgacattacatgcctcgaaaggtttggagtttccacacgtttttttaatcggaatggaagaaaatattctgccacatcaaaccagtattgatgaggataatgttgaagaagaacggcgtttagcttatgtaggtattactagagcacaaaaatctctcacattttctttatgcaaagagcggaaacaatttggtgagattttcaagcctgagcctagtcggtttttatctgagttaccccaagatgatcttcaatgggagagaaatgaaacacatgcaacagaacaagaaaaaaaagaaatgaaaaatgccggatttgccagtttaagggcgatattaaatcaataatgctacctattataaattttatacctactttgtagataaatcagacaaccaaataaattttataaaaaatcgtttgacttatttttagaaaaacgtattataccgcccacaaaccgattgtggtgagatggccgagccggctgaaggcgctcccctgctaagggagtatggggtcaaaaactccatcgagggttcgaatccctctctcaccgccatttactcagtgcatccgtagctcagctggatagagtactcggctacgaaccgagcggtcagaggttcgaatcctctcggatgcgccatgttgatttttgattttattgaactctacaataaaacatacacaataatacattcggttaaaaatcaaactaatacgcacccgtagctcagctggatagagtactcggctacgaaccgagcggtcagaggttcgaatcctctcgggtgcgccatcatcaaaaacccctgataaacaaccaactatagccccttgcgatctaaaataaaaaatgcttgaaaatcaagtattttccgcctatctaaaaacaaagtattatatttatatacagtataaattatgatctaaaaaaaccgattatagaatttaactgttaccaaaaactaatccaaaaacaaaaaaagtgtaccaaataaagaaaaaagggggaatgaaatggcaacttatcaaaaacggggagacaaatggcgagcaatagtccgcaaaaagaacatcacaaaaacaaaaacatttcgtataaaagctcaagcgtttacctaggcaaacaaaatagaaatggaaataatggaaaacttataccgagatgtagctaacataccatttgagcacgtgatcgacagatacctaaacgaagtaacatcacaaaaacgaggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgcacaccaccatcacgaggacttgaactgtagcaatcgtaggtgatatacggataataatcgccacttaaaaacgccggttgttctaccgcaatttcacaatggctatattgccccttcgtgatgtgacgaataagtccatctataaatcggtcatagagactaccgcctcgccccttgtacagagctaaatacaccttactcattgctcaactccttcaaatactccccataactggttgtccacccgctggaataatcatattccgccggattgtccgattgctccatagcggttttatgcttcaaggcattagcatgattacctgttttagcattcattaacgcctgccaaatcagcattaatttttccttatttatcatcaaaaccgagttatccgcacaagtccacgcaatctccatatcaccgaataaatcataactggctttgacggataagatattccgctccgccgtagcgtccgtatcaatccacttgcccaccgcttccacaaacaccccgccattgattttttcatctcgcaaggcattgattttctctcgcatttccgcccgcacttgggttaaatgtgcggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtagattttcatgtgttgtccttggttgttgtttttgctaaaataaacttatatttaacttatattctttattcatgaagtcggttattttccaacccaaagcgttaaagcaattaagaaaaattccaacaggggcgaaaattgcacgaaaatgccaagaattaacgcattttcctttttgttctaatgtaaaagcccttgttaatcatcgttacccctatcgttttagggtcggcgattaccgagttttctttgaaattgccggcgatatgatgaatattatttccattgaagaggtgaaaaaacgagatgaacgcacttactaacattcaatatttacatgatgaaagcggacaccctgcttttgccgtcatgcccatcgctacccttgaatggttaaaacaacaagcaaaactttcctctcctttagatagtggcgtgccttttgctgtggcgacttttgccttagaaaataattgctccgcacttgttgcatggcgtgagcatttaggattaacgcaaaaagacatggcaagccgtttaaatattactcaatctgcatatagtcaatatgaaaaatcatctcacttgcgtaaagccacaagggaaaaatcgcccttgctttaggaattcatgcgacgcaattggatttttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgatctcgagaacaatttattaatgtgtttaaataagattgacaacgtagaaaaaataaacaaagatacacaaaaaacacagggggtttttatgcgacacgatgaattaaagtatgaaaattttacttttttttgggttactcatttgtactacatcagtgctatgtttaccgttattgtgttgtttggtatttcgctaaggatgagttgggaaaccttatctgtcattcattttttcagttccttgcttacttccgtttttttgctttctatccctgtcggtataggttgcgtgttattcacgtttgcattaacgcctttgatgttacttttggatacagtgctaatggcaattcaaaagaaatccggacgttatcatgctaaagaacaggtcgattatcaatttagccttgaatggggcataagtgccatcattcttattgcggttatttgctattttttaatataaaaagacaataacgacaaaaactacggtggttctatgaaaagtaaattgactgttaataattttattgaccttatttttgtgttaattgtcgcatgtccttaccttatttgttatttttattttgatttaagcgttgggctgacgtttatttttggcagtgttgctttattttttatctttgtgttgttttatgatacgtccaatcgtgataaaaattgttgccactgcaaaaataagaatttagatgatgacatctaatcaatattttcactcaatgcgttgatcacaaacgcttcaatcatttctttatcctgctctgtaaggcctagtaattcacgcttggcgtattgtactttgtgttctttgtgtcgttctactcttgctcttaatccatattgatgaatagtggcgatgtaggcggtatttccgctaaaccctagttctataccgtctttttggcggcgtaacttcatgtgccttgcttgggtgatttttttaaacatggcttgggtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtcatgttttttttcctgtaatgtgcggttgtagttttctatgcactgtgtaagtgcttgatttatcagcatacatttttctatttcattgagtgttttatccaaggcaacgacgagatctccgttattttttagtgttattgtcggtttttggcatagttgatctgtcgggcaaagtagcggtatcggctctattaatctgatgtgttcgttcgttgaacaggcggataatgcgattaggcacaggctgaccgctccagctctcatattgtaacgcttgtttaatttcatcagtccgtttctccgcttggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgttgacttatgcgtaactcttgatggtttgctttgacaagggcaataatggcaactacgctacaaatagccnnnnnnnnnnnnnnnnnnnnnnnnnnnnnnnnnnnnnnnnnnnnnnnnnnnnnnnnnnnnnnnnnnnnnnnnnnttaatttgatttctttgtttttgtaataccagttaatcagcatggtaaataagccaaataaaataccaaagatagctgcccagtctgccaaggtaaagccgctataaatggcgatggcagatccgacatacgcccctgttgtttcactattttttaacatgttaaacctcatttaatcccataaactcaatgtatttttgttggtggtggtttgtatatcttcactattaggcaagataacgacggtaccaatggcgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaaatcagggaattttgcccacatatccaagatggcatatttgagatgtgtatcatagttaatttgttggcagtgatacggaattttgtttaacgcatgaatggcttgcgttttacgtcctgtcgcattggtatctgttgttcctgcaatggtacctgatacgcctaaccctaagatttcaccttgttgttcatctaccggtacaatgttgatcagttttaggaaatccgagctttcttgtactgcattttcaagacgttgctgtacacttggcgtcacattaaatttcgcccctcttgcaattcttgagaaatcctcttggttatcgtttgaaataccttgaatgtaattcattaatgtttgtgcggtggtttttttcatcgtgtttaagtcctgataattgattaaaagaaacgtccatcattcatactatcgccactaattaaagggcgttcggtatagttggtatgcggtttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntataaaagctcaagcgtttacctaggcaaacaaaatagaaatggaaataatggaaaacttataccgagatgtagctaacataccatttgagcacgtgatcgacagatacctaaacgaagtaacatcacaaaaaagtaggagtagagtgtttcgaaataatcacatcatcattgattacttttaccgatattttttattcaccttaactattctacttttcaaaagattgtttataaaagaaagcctgttttcacagactttctatttatctcattagaatattagctcggcactaagtttgaagttacgtcccggggcattgaagcggtttaaacctttgccggtgacgtaatcaattttattgcttgtaccaaattgtctaattgaacgagcagaatcccaagtgacatatttacgattagtgagattataaacaccaaattgtaagatcaaatttttgattggtttggcataagcgattacatcaaccaaagtgtaagcatcacttctccatctaatagagctgtcagtggtaacattagtattaccgatgttggtaggattagttattttttcttcattttgtgtttctctccacgtatcattatatgtatcagatgcttttttagcggcaacacgagttacatataaatccacaccaaatttaccatttgtattatgataacttagcccataaatgcttgtttttggctgaatagcattcattggagcggtaatattaacaaattcctctaggtttgcagggtttaaatactctttaacttttactcgccctttttgcttactaaatttataactaaactcaaattcacttaaggctttatgcaaaatgctcaaatttaaacgagcgttaatctcaatcccactcgatttagcggattctctgtttatattttgtctaatttcatatggagttttaccaccatttgaatttttgtgatatccaatcgttctagcaaaatcaatgaagtttttatatttcgtttcaaaataattgaaggtaataaagccaaaatctttatagaaagttagtgcgatttgattcgttttagctaactctggttttaattgaatattaggtacaacatgcaaggtatctccatatttagggttaaaatcccccattttaaatgcgaaatatatttcatcggatgttggtgctctaaagccttttgagtgtttaaattgtaagcgcataaaatcaaaaggatctgtatttacacccaaagaataagaatgtgctgcaaaacttttttctttaacaaaagcatcaatatttgcctgatgacgagctaatttatttttctctgcgatttttttattttgtgcaacagctttatcatacgctaccacagaatcatcatatttatttttgtcctcattatattcatttactttctgataaccataatccgaaaacttaggttcatctaatttttggggtagctcgactggtttatagggatctttaaaatcatgagcgaatccaccgacaatatcatctggaattttgggggtgacgccggcagtatagctaggctgatatttaatttgatcataacgatagcccaactcgaaactaatacgatcatttaatttaaagtcatctgcaaaataaagagcctttgaagttgctttaacaggaactaagaaagagaaaatattgcttttaccacatagactagaataacttgttttacaattctccggatacaatgcccaccatttgacattgatagctgaatcacccgattgattaaccatttctttttgggatttagacaaagagccaccgtaacttatattgtgatccgttttccctaatgcaagatattttgtgaaatctaaattaaattgtttggtgtttgtgttcaaagagcggtctgtccaaagattttggttaaaacccaaagttgaaggtaaaattaatctatgtgaatctagtcccgagccaccactttttaatatcgctaaattacgctctttatctactttaaatcccaatctttggggcttattgtctttatcaataacggctattgttgagtcaccatctccatctttgtctatggtatcacaactaatgccatcacaagataataaaagaggtgcatttgtttggtgtttcttaatccaattattgttttcctcaagagttaagtcagaataaacttgaccatttgaaattaattgttccgtaattgtttttgcatatatagatatcctacacttatcagggtgttgagaagatttatctttataacaacttgttacactagtagggacatcctttaaaactcttaatttttcatatttctcttttatatcatcaggtatcttctcattccaagtatcaaatacatcttgactaatatattcataataagtgcgttgctgatttgaatatttatatgtaataggatttccatctttatcaactaattcattatttttatcgtatttaattcccaatggatttaatgagccaatacatttatcattcccatcacaataatcttcatttatagctcttgttttaattttttgctcggaataagtaaatttcatcgtatcccataaaggattgctagaataattttcataagagaatgtataattggttcgttttacctgatcattattatgacgatattcaagttcgggaggatcatttgatttttggagaccggttgcttttaatgtataggaaagatctgctcctttagagcgactatcatataaatcggcggcaacagtaaagcgatgattttctgtgggttgaaaagacaattttagtaatgtactgtctaaatgtttgtgataaggatctgctttttctcttcttttaccttgtactgtggcatcaaaatggttataaccatagttctgtagttcatgaccatcacgttttgttttcactaataaggcatcaaaccatttataacgaccggctaaggtcatggaatctatatgttgacgatccgcactgttgtaaccttttgtgtaagaaacataccagtctttctctgtgagaaaatctctggcgtccttcgttttaaaaatgacagcaccgcctaatgcaccactgcccactttgattgaattagctcctttagcaagttgcacttgtttcagcgtttcaacttccgcactatttctcgtattattaaaattaccatagccttcaaataattctttaaagccctgagaactcaacgtttccgcttggtgtaaaccatctatcgtaatggctactcggttttcatcaacacctctcattgcatagccactggtaccaaagcgtcctttctctacagcagtgattcccgtttcataacgcactaaatcacgagcatcctgcacttgttgacgttttagttgttttgcacttttaattgtttcgccgacctttttttgttgtatatcttggtcatctaaatctgatacaactttaatctcacctaactccgtgatagttgagttagtttgagcctgagaggggggggaagtgagccataaacggacaataccattgtggctacgatagagagttttattttatgaggtgcatgaatttcaaacatatttctgccttacattaaaaattaagtattttgatggccttcaaccaaatgaacgaagctcactaaatcttcattacttacttggaaagcttgaccaaaaccttttacaaataaaccttgaatcggtttaaaactaaataaataaaaatccttataagtactaatttcatcaattaatgcaccatggcgttctctaagaacagcaatacttgctttccattcttcggtttcacgttcaatcacacgagatgtggcatcaaaagataaacgacggcgagcaaaaatctcacgacttttactttcgtcttcaataagcattaaggaaactttaggtacttcctgtaaattacgtgcgtgacgggcaatggttgaaataaaaacctgatattctccattagaaatagcgaatggggcatagctcacattaggtgtaccatcttgtccaacggtggctaacataatggttttgctttgtgcctttaattcttgaatttctggacctaatcgattttgtaatacttcttgacggtttgttgctgtcattttgatttcctcgttaattaaataaattgcttaaatttttctacttggtgcgggaataactgacgttgttcatcacgaccaagatagaccttaaaaatggtttgtccgttgttagcaataaaggcaatgttgtaactttctttgcctctaaatggcaaactgacaaatgcgatttgggcaagattgccgagtttcacatgaccatgcagtgtgccttcatcatctttcatgttgaggttataataaccacgaccaaccatacctgtaggaaaacgatctttaatttcaaaaatcgaaccctctttttcaataatggttgtaaaagttccccatttgctaatttcagtcataatttccaccgctctttcagcagagaaaattcgcacaaattcctcaggtaatgcacaaagaatattgccttccggttgctgaaaatgttccgccatctcaagcgtgatagaaagagggttttgagcaatgtaatctgcgatttgctgttttaatgtgtgcatataagttttacttaaattagaaattttatttcataactgataattattcttaattgtatttgaatttatctactttgaaaagaggggagaagtggagttgaatcgataattattataattttttaatttaacgttttttagatacttgaagtctaaaataacaaccttatattacgaaaactgctacaagaattaaaaaattatgggaaagaaaaaacgttcagcaagctccagccgttggttaaatgagcattttaaagatccttttgtgcaaaaggcacataagcaaaaacttcgttcaagagcttattttaaattggacgaaattcagcaatcagatcgtttatttaaacatggtatgacggttgttgatcttggtgctgcaccgggaggttggtcgcaatatgctgttagacaaattggagatctgggtcgagtaattgcttgtgatattttggaaatggatccaatcgtcggtgttgattttttacagggcgatttccgtgatgaaaatgtattacaggctttattggagcgtgtcggtgagaaaaaagtagatgtggttatgtctgatatggcaccaaattttagcggtatgccagcggtagatattcctagagcaatgtatttagttgaacttgcccttgatatgtgtaaacaagtgttagcaacaaatggatgttttgtcgttaaagtttttcaaggagaagggtttgatgactatttaaaggaaattcgatcattatttaacacagttaaagtacgtaaacctgaggcatcacgtggacgatcccgtgaggtatatatcgtagctatgggttatatgggatagaaataactggtctgttgtcttattgataaataatagccaattaatctgataactttaaatccaaatagatttatagtatcttatgaaaaatttttaattactgaaatatggagttcaaaccttgaacgatatggtgaaaaatatagtcctttggatcgtagtcgctgtcgtcatgatgacagcctatcagagttttagcggaaactcatcaaataacgcaattgattacaccacttttattagcgatgtagaaaataaccaagtttcagccactaaatttaatgaggtcggtgaaatttttgtaactaaaaaagatggttcaaaatatacgacagttcttcctacaccgttagaagatcgtaagttattagacgatctgattaaatcaaaggtgaaaattgatggtgctttgcctgagcaacggggatttttatcgcaaattttaatttcttggtttccaatgatcttattaattggcgtttggttcttttttatgcgtcaaatgcaaggcggtggcggcaaagcaatgagttttggtaaaagtcgtgccaaaatgctaacgaaagaacaaattaaaactacttttgccgatgttgcaggctgtgatgaggctaaagaagaagtcggtgaaatcgttgatttcttacgtgatccaagcaaattccaaaagttaggtggtaaaattccaaaaggaattttaatggttggacctcctggtacaggtaaaaccttattagcaaaagctatcgccggtgaagcacaagtaccattttttacgatttcaggatctgatttcgtagaaatgtttgttggtgtaggtgcttcccgtgtccgtgatatgtttgaacaggcgaagaaaaatgcaccttgtttgatttttattgatgagattgatgcggtcggtcgtcaacgtggtgcaggtcttggaggagggcatgatgaacgtgaacaaaccttgaaccaaatgcttgttgagatggatggctttgaaggcaacgaaggtgtgatagtgattgcggcaacgaatcgccctgacgtacttgatcctgcgttgactcgtccaggacgatttgaccgtcaagtcgttgttggattgccggatgtacgtggtcgtgagcatattttaaaagttcatatgcgaaaagtgcctgtggcggatgatgttgatgcaatgacattagctcgtggtacaccgggatattcaggtgcggatttagctaatcttgtgaatgaagccgcactatttgccgcacgtactaataagaaattggttaccatgttagagtttgaaaaagcaaaagataaaatcaatatgggacctgaacgtcgttccatgattatgacagataaagtcaaagaaagtaccgcttatcacgaagcagggcatgcaatcgttggttacttagtacctgaacatgatcccgtacataaagtgactattattcctcgaggacgtgccttaggcgtaactttctttttaccggaaggtgatcaagttagtattagccagaaacaattggaaagtaaactttctactttatatgcgggtcgtttagctgaggagcttatttacggtgaagaaaatatttcaaccggtgcttccaatgacattaaagtggcaaccaacattgctcgtaatatggtaacgcaatggggattttcagataagttgggaccgattttatattcagaagatgaaggcgaagtgtttctaggtcggtcaatggcgaaagctaaacatatgtctgatgaaaccgcacatacgatagatgaagaagtaagatcaatagtgaatcgtaattatcaaagagcaagacaaattctgattgataatatggatattttacatgcaatgaaagatgcgttagtaaaatatgaaactattgaagaagagcaaattaagcaattaatgaatagagaaccggttgtcgctcctgcaggttggactaataatgagtaaaatttatttgtagttttggcaacgcttagtaaaatcttccgactatgttgtaggttctgattttttaataaggaaaaggggttaaacgtcggtaatgtaacagaagtaaccccaaacaattattctttatttttggtagagtatgaatttgggattttgttacgagacggtggaagaacagttaataatattgcaaaaaacataataattggggctatctactatagcccctatttttattgcaatttagataaagtttattttttatcgttactgagttttttattgaaaaataaatgtgattaaaaaatataaagactgagagtatagttatgaaaaaaatttttttaaaagaattacaaatgatttctttagatattttggattattttcatcatatatgtgaagcacataatatacagtattcactgggggggggaactttgattggtgcaattaggcatcaaggttttattccttgggacgatgatattgatgtatatatgctgtggagtgaataccaaaaatttgtctcagtttggaataaattatcacataatttctataaactatctcctattgaaacttttgatggggatgttgtgggggaaatggctaaaatttatgatgagagaacttatttatcagaaaaacatagggcaagtcatatatttatagatatttttattttagattatgtgcctagtgatttaggtattttgtataaatctatgaagaagcatcgtagattaacacttaggtttaagtctttaaggaaacgtttttatcgagctaaagataagagcggttgtaaaaaaatacttggtaaattatcacaaatttattatgaaaaaatgcaagctaatctcagtcgattaagagaaacgtacaatgaaaaaaacagtgataatatcggtctttttttatctgactatgcttgctggaaaaaatcttatatgcctaaagaatattttcggtcgtttaaaaaagttaagtttgagaataaatatttttatgtaacggagtattatcatcagcacttaacagattattacggtgattatatgacattaccgccggaagatgaaagatctcctaagcatggaatagaagtatattggaaagagtgaggttacaaaattttatggcttatttttttatctaaattaacagcaaacaataaaacaatagataacttagagaaacaaaatgttgtaagttagattaattgaaggactgaattttgtatgttaaatagacccagtccttttagtttgatacaaataatatctgtaataaatttctgtaatttttattttttaaagataatgtagatctgaaataacatgtgtaatgctattaaaaggttagtgaggtgatacattttttagttaattgaaaaagtatcactttcgtccattagattttagcccgatttttaggtatagccagtaaaattggtcatgtttcctattattaaaatttcattgaaatactcatcttaacattacgtccaacacctgaaactttttcacttagataagggttgtacttgcgattaaagatattgtctatgcttagagaaagcttcattccgtgtattttcttaggttcccatatggcaaatagatgatgtaatgagtagccgttggatttaggaagtgaccaataccctgcttcaggatcgttatcgataggtgatctatcttggcgacggaaaaactcaccttgccaaccaattgatatattccatttgggtaggtttgtacctaatgtaattattgccttacgaggagggatctctgctatccaakttttgcttctagattaattaaaggatgatctgatatgtaagtccagtctagagcaacactttcatcagtcagtttgcgatataccagtttccttttccaagcaatatcttctccccatttctttatgtcggatatacttggtgagggtaaattatcacgcatagcggcaaatggtgtccaaccagagttattggagcgtacagctgaaagcgtcaattgttgcttatctgaaggataaaaattgacttttaatagatagctattattgtcattttcagagtataagaaacgagaaccatctgggcgttttatgttatgactattacgaacggttgtgtaaaataagccctctagatttttttcttgattgcgtagaaaaattgcaccgctccaaatattctgtttatcattcgtatggtaactatatttagcaaatccaccaacattttgattttcattgagaaagtcgctcggatttttagtcataaattttaaggttccgccaaatccgccattcccatattttgcagaaaagctgcctttatctacttccacccgacgcagtaattccggttctataaatacagatccttgacgatatctttcaaagtttttttgtataccgtctaattcaatacggacatcttcactatcaccaaatccccaatattgatattttgacctcccggtctaggtgaacctgacatattgacaccaggcaaaacattaactaaggctgcggcattgtcagcttgctgtcggtcaatattttttgttaatagtgttgaacgtccgatatcatactgttcattttgaactaagatgacaggaagagcgtcgtattgttgagcgattaatttgcttgtataaaacgtagatgaaagcaatatagtgatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatgtatgaaggggggggaatttaacaaatttattgcacatgactatcgtaattaatgtaaataattgggaatataactaattatcattttaatgtaaagatttttatccgagagaataaaaaagaatatgaattgcataaacattcaatatagagttcaaaggtaagctactttgggcgtttttcagtgttttattcattatttttgtatttattctcaaaaatttttttatttttgttcattccaatattccgctataattgaccgcacttttaacttgattgcgtagcagagcaaatgaaattacaagcaaacaataaaactttggatcttactttacctaaaatcatgggaattttaaattttacccctgattcattttctgatagcggacaattcttttctttagataaagccttatttcaagctgaaaaaatgctgaaagctggtgcttcaattattgatattggtggtgaatccacccgtcctaatgcggcagaagtaagtttggagcaagaactggatcgtgttgtgcctttagttgaagctgtaagaaaacggtttgattgttggatttcagtggatacttctaaagctgaagtgatgttggaaagtgctaaagttggtatggatataatcaatgatattcgtgcattacaagaacctaaagccttagaaacggcagtaaaattagggttaccgacttgtattatgcatatgcaaggacaacctcgtaccatgcaacaaaaccctcaatataatgatgtggtgcaagatgtactggaatttttgcaaaatcacaccgcactttgtttacaagcaggcatgaaaaaagaaaatattatttgggatcccggtttaggttttggtaaaactgtgcaacagaattataaattattacagcaagttacccgattttgtcagcaggatattcctgttttagtggggttatcacgtaagtctatgattggtgcggtgttggataaacctgtaggacagagagtaataggaagtgcgacaggtgcattacttgcggcaatgaacggtgcaaaaattttgcgtgtacatgatgttgatgaaacattagatgcattgaaaatttggcaagcaacagaacaggcttagttttaaagagttgttctacaataagttgatttcacagagtgaaggataattttgcttctcttgcgttgatgaataatcaaggaacgaaaaatggcggaacgtaaatattttggaactgatggtgtgcgtggcaaagtaggaagttatcctattactcccgattttgtgcttaaattaggatgggcagcaggtaaagtgctagctacacagggaactggtaaagtcctaattggtaaagatacacgtatttccggatatatgttggaatctgcattagaagccgggttggcagctgcaggattatctgccgcatttaccggaccaatgccaacaccggcaattgcttatttaacacgtacttttcgttcggaggcggggattgttatttctgcttcacataatcctttttatgacaatggaattaagtttttttctgcacaaggtacaaaattacctgatgatgtggaagaagcaatagaggctatgttggaacagcctatggattgtgttgaatcagctaaattggggcgtgcaagccgtattaatgatgcggcaggtcgttatattgagttttgtaaaagtacttttccggcacatttaagtttagataagtataaaatcgtggtggactgtgcaaatggtgcaacttaccatattgcaccgaatgtcatgcgtgaacttggtgcagaagttattgaaattggtacgcaacccgatggtatgaatatcaatgaaaactgcggtgcaacagatatcaaagcattacaaaataaagtattggaaacaaaagctgatatcggtttagcctatgatggcgatggtgatcgcttaattatggttgatcattttggtaataaagttgatggcgatcagatcttgtttattattgctcgtgaggcgttacgttcaggtaacttaaaaggtggcgtggtgggcacgttaatgagcaatatgagcttagagctcgctttaaagcaattgggaattccatttgttcgtgcaaatgtaggtgaccgctatgtgttagaaaaaatgcaagaatataattggattttgggtggtgaaaattcaggtcatattattattgcggataaaaatactaccggagacggtgtgatcgcttccttggcggtattagctgcaatggtgcaacataaattgtctttaaacgaattagcaagtgcggtgaaattatttccacaagtgttaattaatgtacgttttgcaggtggtgcaaatccattggaaagtgatgcagtaaaagcagttgcaacagaggtcgaaaaacaacttgcgggcaagggcagaattttattacgcaaatccggaacggagccattaattagagtgatggtggaatgtgaggatgctgaactggcacagctcagtgcagaaaaaattgctgaggcagttagagctaattaggtgtgataggataatgaaaatatttgtaatgcgacatggcgaagcagaagtgatggctaattcggataaagaacgccgtttaacctctcgaggtcggttgcaagctagcgagcgaggttattggttaaaaacggttattcctgattttgataaggttttggtaagtccttatagaagagcggtagaaagttttgaaaaaatcgatgaggcttatcatcatcaactaagttcaaaacaggaaatttgggaaggtattacaccttatggaagtagtcatttggtgatagattatttatccgtattggcaaataaaggtgttgataaggtcttgattgtttcacatttacctttagtgtgggatattgtcacagaattgtgttctaaacgtagccctatcagtttttatccctctacaattgttggtttacagtgggattgtgagcaaagtgcggtcattacggagataaaatatccggagtagtaatatgcaaaataacgatttcttatccgcctttattttttcaaccagcgttactctgccgacattgttaatgctgatgttgggtgttacgttacgagcaaaacgagtcattgatgatcgtttcagcggacaagcgactaaaattatttttaatattaccctgcctgttttattatttttaagtatttttaaaaatcctgtggattatagccaacaagtgcctcttttattggcaggagtggttggtacattaattttatttgttggcgctgaaatgtttgctgcaaaatttgttacagataaacgtgaaagaggcacttttgtgcaaagtgtttatcgaggtaataacggcattttaggtttagcattttgcattaatgcttatggggatttagcgttggcaccggcgtcaatttatgcggctgcattaacttttttatataatattttaggtgttattacgctaagtcgttctttatccgatggtaaagtcggtgtcaaaaaaattgttttcaatgttttaaaaaatccattaattattggtattttgctcggtattttggcaagttttaatcaggtggtttttccaaaagcaatcttgacgaccgctgattatcttgcgagcatgaccttacctttagcattaatttgtaccggtgccagtattgatgtgaaaggattatttaagattaatgcggtatctttatgggcgagtatcggacgattactggtcgcacctatttttatggtagtgattggcaaagttttaggtatcaccggtatacatttaggtatcgtgttattgatgtcttcaacacctttagcaactgcggcttatgccatgatcagaggaatgggaggcaatgctgtaacagctgcgaatattattgggttgacaacttttggatctatgtttagttctgttacaggtctgttattactgaatcaaataggctggatttaaataattttttcgtttttatttgattttgttattattcggtaacgtttatatcgtgaatttattttttggcaaaatataaccgcactttggacttatctataaaagtgcggtttaaatttataaatcaatgcaacaaatcattcaaacattttccgacaacggcgtattaagtaaaaatatcaacggtttttgtcctcgagttgaacaaacggaaatggcaaaagctgtagctcgggcaattagtcaaaaaagtactttagttgtggaagctggtacaggaacgggaaaaacatttgcgtatttagtcccggcgttattggcaaaaaagaaaacgattatttccacaggttcaaagaatttacaagatcaactttttagtcgagatctccccactataaaaaaagccttgaactatagcggtaaaattgccttattaaaagggcgagccaattatttatgtttggaacgcttggaacaagttattgctcaaggtgttttggggaataaagaagtgttggcggatttggcaaacgtacgtcgctggaataatgcaacaaaaacgggcgatttaactgaatgtgttgaacttgcggaagatagccctattttaccgcaactgaccagtacggcagaaagttgtttaggggcagagtgtcctcattatgcagattgttatattgcccttgcacgcaaaaaagcacttaatgctgatttagttgtagtcaaccatcatttattttttgccgatatagtcgtgaaagaaagtggttttggtgaattaattccgcaagctgaagtgattatttttgatgaagcacatcaacttcccgacattgcaagtcaatatttcggtcaaagcattacttctcgccaattttttgatttatgtaaagatattaatattgtttatcgaactgaaataaaagatatggcacagcttggtgtagcttccgacacgctgttaaaagcggtgcaagactttcgtttattgctgggtgaagggaatttaagaggcaattggcgtgaagttttacgccaaagtgcggtagaaaaatcgttcagtttgttacaagaaaaagtggattttacagcggaagttatcaaattagggttaggacgttcacaaacgttagacagtatttttgagcgtattattcagctgaaagcaatgcttcaacgcttacaagcaacaaatatcgtaggattttgttattggtatgaaaccatgggaaggcaattcggtttacatattacacctttaaccgttgccgataaatttggtgaacaaatgaaagctaaagaagtcgcttggatttttacctcggcaactttagaggtggcaggaacgtttgctcatttctgcaaacgcttaggtattgaaaaggcggaacagcaagttttacccagcccatttaattttaccgaacaagcactattttgtgtacctcgttatttacccgtcaccaatcatcgtaacacattaaatcaattggctgaaatgttattgccggtgattgaaagtaataatggatgttgttttgtcctttgtacttcttatttgatgatgaaaggattagctgagtattttcgtgaacatagtcaattaagtgttctgcttcaaggggaaacttctaaaggaaaactgttagagcaattcattaaagaagatcattctgttttggtggcaacgtcgagtttttgggagggagttgatgtgcgtggaaaagctttatctttagtgattattgataagttaccttttactgcaccggatgaacctttacttaaagcaagaattgaagattgtcgtttacaaggtggagaccctttcaatgatattcaaattccggaagcggtcattgccctgaaacaaggtgttgggcgtttaattcgagatgttactgatcgaggtgcggtgattatttgtgatagtcggttggtttttcgaccttatggtgaactatttttacatagcctgcctaacgcaaaacgtacccgagatttaaacaaggtggtacaatttctggctcaaattaaaaaggagaaataacagaatgatgacaactttattagcacttgatacatcaacagaagcctgttcagtcgcacttttatacaaaggagaagtcacctattttgatgagttggcacaacgcactcatgctaaacgcattttaccaatgatcgatgagattttggtgcagtccggtattcaactaaatcaattagatgccttggtatttgggcgtggaccaggaagttttaccggtgtacgtgttggtgcggggattgtgcaaggcttagcttttggggcggatttgcctgtgattcctatttctaatttaaccgcaatggcacaacaggcttatgagcaatatggagcggaacaagttttgtgtgcaattgatgccagaatgaacgaagtttattttagtcaattacaggcagaaaaagtgcggttggaaaatactgattttgttcaatggcaagagttagtcaacgaacaagtttgttcgccacagcaggccttagctcaattaaaagatatccagattgaagattggaccatggtcggtactggttgggaatatgctgaattcaccgtagcgggattgagtgagaagacgcaaattgatttaccatctgcccgttatatgctttctctagctttgcctttttatcatcaaaaacactggataagtgcggtagaagttgagcctgtttatttgcgtaatgaagtaacttggaagaaacttccaggacgtgaataattcatgatgtgtttatttttctattgctcgtgtacttgctgaattttattttgaagaaaatcttgatttataggggaagattgaaagatgttttattgcattgaggtttttgctaagagaaataaatctgctcaaaataaaaaattgaagtataatgcacccgatttttcacagaaaaatagtaaaaatgatagaaatatcagttaattaaagaggataaataccatgcaaaaaacttggtttcaaaattaccctgagggctcaccgctggaattggacacttcaaaatatgaaagtttgttagacatgcttgataaagctattcgtgagcatcctgatcgtccggcttatgtaaatatggggcaggttttaactttccgtaaattagaagaacgtagtcgagcttttgctgcttatttacaaaatgaactaaaattaaagcgaggtgagcgtgttgctttaatgatgccaaatttattgcaatatcccattgcattatttggaactttgcgtgcaggtttggttgtggtcaatgttaatccactttatacaccgagagaactggagcatcaattacaggatagcggtgcaatagcaattgttgtggtatcaaattttgcgtcaactttagaaaaagtcgtttttaatacgaatatcaagcacgtcatcctcactagaatgggggatcagctctcttttggtaaacgtactttggtcaattttgtagtgaaatatattaagaaattggtgccaaaatataagttaccgagtgcggtaacatttcgtgaagttttggctgtcggtaaaaaccgtcaatatgtacgtccacaagtggaacgcactgacttagcctttttacaatatacaggtggcacaacaggtgtggcaaaaggtgcaatgttgacacatggcaatattattacaaatatttttcaagcggcttggattgcctcaccctttgtaggcgatcataaaaaacagcgtaaagccattatagctttaccgctttatcatatatttgcattaacagcaaactgtttactttttattgaattaggtattaccgcagttttaattactaatcctcgtgatattgacggtttcattaaagaattaaaaaaacatcgttttgtagggataacaggggtgaatactttatttaatgccttgctgaataacgaaaactttaaagaggttgatttttccgcattgaagttgtctgtgggaggcggtatggctatccaacaatctgtagcgactcgttggcatgaattgactggttgcaatattattgaaggctatggaatgacagaatgttcgcctttaattgcagcatgcccaatcaatgtagttaaacataatggaactattggtgttccagtaccgaatacagatattaaaattgtcaaagatgacggttctttagctgaacttgatgaacctggagaactttgggttaaaggtgagcaggtaatgcaagggtattggcaacgtccagaggcaacggaagaagtgttaaaagacggttggctggcaacgggtgatatcgttattatggataaaacttatagtttacgcatagtagatcgtaaaaaagacattattattgtatctggttttaatgtttatccgaatgagattgaagatgttgtaatgcttaatcctaaagtagcggaagttgttgctattggtattccggatgaagtttcaggtgaaaaaatcaaaatttttgttgtgaaaaaagatgatagtttaactcgtgatgaaatacgccagcattgtcgtcaatatcttacagggtacaaaattccgaaatatattgaatttcgtgatgaattaccgaaaagtaatgtaggtaaaattttgcgtcgagtattacgtgatgaagagctggcaaaacatgcgtaaaaataaatatcaagtgggcgattaaacgcccactttttgtgtatcgttttacccacaatgatgtagccatgagaaaggttattgaataatagataattagcaagtatgtccgttttaataaaagaaatccaaaattcaccgcagtttcaattgattactacaaatgatcgtttatatgagatttgccaacaggcacaacaaaaaacggtgattgctttggatactgagtttgttcgcaccaaaagtttttatcccaaactaggattgattcaactttatgacggtgagcaagtgagcttaatagatccttttgagttgagtgatttttctccttttattcaacttttagccaatcaaaaggtcacaaaagtattgcacgcttgcagtgaggatctggaagtttttcaacattattttcagcagttgccaacgccaatgttagatactcaaattatggcggcatttttgcaacatggcaattccattggtttagctacattgctaaaacattatttcaagctggaaatagataaagggatttctcgcactaattggcttgctcgccctttgtctgacgtacaattgcactatgctgctgccgatgtatggtatttattgccattatgtcaacgtatgcaacaaaaattagctcaaacctcttggcaaagtgcggtgcaaaatgattgtgaaaatttgttgaaaaaatatactcagataaaagatagtgacaatgcttatttttctatatccggagcgtggaaattaaactctcaggaattaatgcgtttaaagctgttagcaaaattgagacaagaagaagcgataaagcgtaatcttgcattaaattttgttgttcgtgcagagcatttgattttattagcacaacataatccaaaatatacttcacagctgttatccattggtttatctccgctggaagtgcgtattcatggtaaaaaaatattacaactcttagagaaagcaaacaaagcaccggcgtatgactatccaccaccaattttgcgagtcactgatgatcatcgttatcgtgtagcaattaaattgttacaagcaacgttacgggaaatcactccggcagatttaccgactgaagttttgtcaactaagcgtatgttagatcagctgataaagtggcattggattaaacaagacaatcctcatgatttacctgatttgctttgcggatggcgtagggagtttggattattgttattaaaggctttgcattaattagatgctttcttaaattttttggaacgaactcaagaaatcaaagggtatacaaattgataccctctatatttttagacagggaagaatgttgatctcttccctatatgtcaatctttaatcaagatatttgattactttaattactttatttacccctgaaacatgacgagcgacttctgcagctgcatctgcttgagattgagttaaatttcccattaagaatacttcaccattttcagtaatcactttaatatccgctgatttaatatttgaattgacgaataacttagatttaatttgtgtagtgatccagccatctttactaatttgtccaatagtaattggttgtgcaaggcgtaactcattatatacttcgtcaacaagttccactcctctagctaaattagttgcctgtacttttaaactattattcggaacttgtccgattaataaaattcgggagctataagaaactacattaacacgcccttcagcttttatttgtgcatcttttttaatcgctgacaagactttttcttccaatgtttcatcatcaatttgagtacctactgttctcggatccgttgcaacttttaccgcaactgccgtaccggtagcaataccaatcacagtggctgttgcacaaccttgtaataaaagagctgaactcagcaatagccctaacgttttatttattttcatctgatttctccttgttgaaattttgcctagtttgggttgaaacatggctttttgtcaagaactatgaatgtgaaaataatgaataatcaataagctcacataatgtgttaataattagcagatgattttcaagaatacgactttccttaccggtcggtactgaaatttctaaatcatttgccgttaaaaatccttgtatatgaccgttattttcaccggttaaagcgataatttgtacatctttatttaatgcacattgcaatatatttagcatcgtttcttcattgccgaaaggagaaaaaataattaatagatcaccttgttgtgcaattgcgttaaattgtctttgatacaacatagtatgacaattttcggaaataatggcagaaccgaccgcactatccaaacttaacagaacggaaggaaagctagggcgttccaattcatatctattgagtaaatttgctactaaaaattgtgcattagcataggatctaccatgcccactgacaataattttattacctttcagcaggcaatttacaatatgttgagttgcctctacgatttttgttgcaagtaagctggaggaagaaatttgagtttgaatactttccgtataaatatctttaactttttctaacataatttttattcatcaagaaaattaggtatccattggatatcatttgttgttgctccaaaagcgactagatcgaaacggcagtccgcatcttctaaactggaatcatattgtgctaaccataggttggctgcatcaagccatttttgctgctttttccaatctacactgtcaattgctgaaccgaaaatttgatttttacgctgacgaacctcaacaaaaacgatcgtttgccgatcttgcataatcaaatccaattcaccgcagttaaagcgttggttagcagcaataaaggttaaaccttgtctctctaaaaagaggcgagcctgatattcaaaactcgcaccttgttgacgtttggattgtatcattcttcgttaatcagatagatgctgtcatcttgctcgttaagcggatagatactgccattttgatattggaaccaagtcatatcacgttcaacattacagttagggccggcactgagttttcctgttaacccatcaatggtaaatccgggaatttgacggaattcattaaattgatttattaataaccaagcatcataacccatagcatataaatgcattaatgagtaatcattattggtcattttttcaatttttttatattgttccgattccctatctttgaagaacggaatatcactaaattgcagattattcagaaacaaacgatgttcagggccactgttaggcgaattactacgtgaacttgcataaagttttagggtcggattaatattatccaacactgctttaatttcagctaattgtttgttattagcaataatatacacgccgtcagtactttcacttaaccccgattttaatgcaaaattaatatctgcggtttgattatagaatttaatattggcatcagtacccaatagttgttgccaacgtagagtaaatgccgctgccgtgcgtcgccccagattattttgcggtactaaaacaagtggaatacgtactgtatcattccacattttacttgccgcactttcagcttcatcttcaggcgataatccataataacaaaggtgttcaattgcccgtgcattaggcgtagagttcaacgctaatacatttaaatcttgtaccaaatacggattattgactataacatcaacattttgtttgagtaatggtccgacaagagtgttaattccctgtttttttgcttgattaataatttgttctatagacattttcattgagtcaaatacgtgaacttgaacattgtaattgactttggcatcatcaaacccgtttttgattgtttcaccgataagtcgtgtattgccgcttaaagggagtattagaccgacttgcgttaaagtagtttgttgaaaattggcaagcccttgtaattctgtaggtaataaatgtgctgctgtatgtgttggataataatttttccaagtcagtaatgtttgaattaattgtgcaggttgattaaggttatcattgtatagttgagctaatgttaaccaaccgctcaatgtaatatttccttccgcatcagtattatttagtacttcactatctgtattgcgtagcaatgcccaagtgcggtcattattttgttgttttcgttgaatatcacttaaaaaattatccatttgaattcgagcttttatcgctgaaatattatcatgacgattttctgcaatacgagaaacaatctcataataacgtgatttttgtgaaggactaagtaatgtcaagtgaattaaagataattgatattctgccgtttcatttttgcctttaacagcagaaatatgagcttcaatcagggatttatctagtttttgttcatcatttaaatctatcaattcagcaagatatgcttccgcttgcgggattttattttctgttactaaaactcgagcagctaaaagtttataggtttgtaaatcttgttgattttgtgtttgttcaattttccgaatgtaaaaatcagaacttgcattggcatcattttttaagcttgccgtaaagctactgcctaataaattgacacagcctgctaaaaaaaacataactaaaatcgggagaaagcatttttttaagcgtaaaccttgcattaaaatagataacataaattgctccttgagtatgtgcaatgtaaaatgcacggtgatcttacttatctcaccaattaaaagcaaataaaagaagtgaaaaatgaataattcgacaggaattctatacgttgttgcaacgccaatcggtaatttacaagatattactcaacgtgctttagatgtatttaccaaagttgatttgatcgctgcggaagatacacgtcatagcggtttattactgaatcactacggcattaaaagaaatttttttgcgttacatgatcataatgaacaacaaaaagcagatgtactgattgagaaattacaacaagggttaaatatagcacttatttctgatgctggtacacctttaatcagtgatccggggtttcacgtggtgcgtaaatgtcaccaagcaaatatccgagtagtcccattacctggagcttgtgcggcaataaccgcattatgtgcatcaggcatcgcttccgatcgtttctgcttcgagggatttttacctgccaagagtaaggcaagacgagataaattggcaaacttaacaaatgaagaccgcactttgattttttatgagtcaacgcatcgtattttggattgcttgactgatattgaacttgaattgggagccgatcgttatgtagtgcttgcacgtgaaatcacaaagacttgggaaacaattcggggggatcagattggaaggttgcgtcaatggttacaagaagatcctaatcgaacgaaaggagaaatggtgctaattgttgagggcaaatcaaaaagagaagatgaaacattttcccctcaagcgattaaaacattacaattggttagccaagaattacctttaaagaaagcagcatctattgttgctgaaatttatggctataagaaaaatgcactttaccaatttggtcttatccaaggttactaatataatgaggctataatctcaggtttaatttgggtataatcgccaaactttttaggtctgatttttaaggacaaatatgagtcaatttttttatgttcattcagaaaatccacaatccagactgattaatcaggcagtggagattttacgtcaaggcggcgtaattgtttatccgaccgattccggttatgcactaggttgtatgattggagataagcatgcaatggatcgtattgtgaaaattcgccaactacccgaagggcataattttaccttagtttgtagcgacctgtctgagttatcaacttattcagtagtgaataattcggtatatcgtttgattaaaaataatacaccgggtcgttatacttttattctaagtgcaacaaaagaattaccccgtcgtttaatgacatcaaaacgtaaaaccatcggtattcgtgttccggataatcaaattgcgttagatctattaaaatccttaggcgaaccaattttatcctgctctttaatgttgcccggagaagaatatacaacacaatccgatccggaggaaattcgagatcgccttgagcaccaagtagatttaatcattcatggcggatatttaagtcagcaaccgacaacagtagtggatctgacagaagataacccggttattttacgagaaggaagcggtgatattcgcccttttatataaattaactttattcattcccattatcatagacgcttgtgaaagcgacagtaaggaaaataaatgaaagtaaataagcaaaaatcccgtccaactaaaccgcactttgcaaagcaggttaccaacgagtctatgcgggataatacgaagcgatttgcaaacaaagaaacagtatctgaacgtaaaagtgcggtaaaaaacactcaaatttctccaacatcaacaaaatcaactcatgctgtcaatcagcaaaaagtcgaaggggaaagactacagaaagtgttggctagagcaggacaagggtcacgtcggacaattgaagcaatgattagtgccaatcgtattagtattgacggaaaaatggcgactttaggtgatcgtgttgatatacattccggcgtaaaaatcagaattgatggacatattgtcaatttaactcaagcacaaaaagaagtatgtcgagttttactctattacaaaccggaaggagaactttgcactcgacatgatccagaaggaagagcaacggtttttgatcgtttaccccgtttaaacggatctcgttggattgcggttggtcgtttggatattaatacatccggactacttttatttacgactgatggtgagttagctaatcgtttaatgcacccacgacacgaagttgaacgagaatatgccgtgcgtgtttttggggaagtagatgatgcaatgattgctcgtttacgtaaaggcgttcaattagaagatgggcctgctaactttaccagtattaaagcaacaggcgggcaaggaatgaaccaatggttcgatgtcaccttgatagaggggcgaaatcgagaggttcgtcgattgtgggaatcacaaggcattcaagtaagtcgtttaattcgtattcgctacggtaatattaaattaacgaaatcgttaccacgtggcggttgggaagaaatggatttaaccaatattaattatttacggaaacttgttgggctaccgcctgaaacagatagcaaaattgatactaaaaaacctcgtcgtataaaaacgggacaaattcgaaaagctgttaaacgctatgctgaattgaataaacgttataagaaataaaaaacttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaacttatttaaaagtgtgaattaactcacaaattttaaattacgtatttgcattatagaacatgattttttacattgcaccttataaaaagtgctataaaaaagtagccaacatattttgctttccgagtagtgcctcttttgaggcactttttttgtgtttgcataaaacaaaaaacctagcaattcaaagattatcgctaggttagataaataaattagttaaacacgccgctgatgccgacacggaaaccgaggcgaccacggctgtcggaggacataccgccggagacagcccatttaccatttttggaagttctgccgaggtttaaagagaccgcactttcgctgctataatgagcggcaccggcggcataagaccattttcccgggacgaaagggacttctttgaaagccatcgcggcggcgataccggcttttgcgtctttgttgacttcttcaagacgttggttagtggcgtgtaattggcttccgttgacggcatcggttgattgatgagaaagcaaaccggcggcaacattttgaatacggcgttcattgcctttgctgcccacggaaacgacgccttttgcatcaacgccggcgtaattgccgttgactttaccgataccgcccgttgtttcgcctttttctacataagcagaagaatcaccgaggaagacggagttatcaacctcaacattaatattattaccgataacggtagttttagttcctttgtttacaatactactaccaattgagaatgagcgttctttatgtgtttgtacatcgttaccaatacttaaagagcgatctccatacacttttgcttgaggaccgatggcttgtgatctaagtccagcagcatgtgaatcccaacctattgctgtagataattcattgatgcttttagatttataaccaaaagcattactataattgccagaagccgtagcaccttgtccaagagccgaagcaaatttcgcagttgcgtttgcctcatcacctactgctactgcaaactttccttgtgcgttggatttgttacctatagaaaccgcctgtacacctgcatttgcttggtagcccattgccacggcataagcttgagcttttgctgttttaccaaccgcagttgctccttcatgtgcagcatttgcatcaaagcctacagcgacactagactcagctactttggcattttttccaacggcaacggannnnnnnnnnnnnnnnnnnnnnnnnnnnnnnnnnnnnncttcaccaatataaacatgcccattactaacatcaatattactactatttgattgttgagcttgagccatagccgaatgagcagttaaaacaactaccgcagttaaagataaataaaaaattttcacttaaaagaaatccttaaaaaaagagttaacatagaaaaatcataaaaaagctaaccgcactaagakgcgataatttatgacacgccttaaaaagaggtagtggttctaccaaagcgggcgaaattttaagcgggggggggtactgtcaataaaaaaatgaaaaaatgtgaaaaaagataaaaaaagtaaaaaatgaagayaagarkywaaaaagtgagaagtacaagtaaaaaaagtaaaaaaagcccgcactttttaacaaaaagtgcgggttggattgggaaatttygggttatgtagaaagcgagaagctatgatgatagttttggcttgtggcttataagtaacgtttaatctgttaagattttttttaccttctctttcatttggttgaactccaatgatattcattggagagtagttctgaaagttcattgaaagtattttgcgtaaaaaagaggaatgacagccccttaatttagcgaggggaattagtagaataatatcctcccatcgcactgtaaatcgcattttgactttgaattaaactgtatttcgcattcagaatggctaattgagaggtattttctgtattagcggcattaagccattctattaattctgcgataccggcatcatagcggtttttgtaatattgcgtaatacgtttgttgtaacggtaagtctcttgtaaatttgcaacattttcttttgcttgggtataagagaaatagaggttgtctatttcatttagagccttggtgatgttttgttcaaaactcagttttgcattttcataagctgcctcagaaattttaacattccattttactgtattccaatttaagaaaggtaagtttatgcctaccgttcctgtcgcaatcggtatgttgaaagcattgtcaattttattaccgcttgatgataattctgctcccagtgtgattgatggaaaccaacttttttgcattgctttcgcatttttaaatgcactattgaggcgatataaagagcctttaatatccggacgattggcaatggttgataatggaatatccaaatttacctccgcacttttgacttccaagatatttggtgttttgatgtttaaatcttcattcggttttaagttaagcaaattacgcaggatagtttcggcacgttttttttgtgtttgataattaatcagattattacgagccttaagaattgattgttgtgattgatctgtagttgcccgatctgctacaccttgcttgaatttattttgcataattcgactaatttttgagtaataattaatcgtttggtttgttactgcaatggcatcatttaaataggcaagttgatagtaagttgtgacaactgagttgatcagagagagttttgttgcttgtaaatcttgttgcgtagcggaatgtgtccattttgcagcagaggttttatcggctaaacgttgccataaatctagggtgtagctaatattgagtgaaccgccgtgagtaattttagagttgctccctgtgttaatatttttggcagctgaagaattaacgcctgtttggcgtgtgaaatttggtactaaatccgccgcaaccaaattggcattgtacagagccgtgtttactgcaatagtggctttggcaagatctttattattttccaaagcttgtttcaccagttggttaagcggttcgtcattatattgtgtccaccaattttcctgaatgttatattgttgagtcaatgcttcatattgctgaaaatcttgtaatgttgcatggtaactatcatcaatatttgcacaaccgattaatatattagacaccactattgcaaacgtcattttagaaagttttaacataagttttccttatcttgtaagcagaaaagtgcggtctttttttccgcattttctgcaaattttatcatgcttttattcatgtgtcagagaggaaattgagtttaatttagatgcctttttgaaggtatatttactttaaaaaatggcttggtagttcctgatcacatacgattatgtcaaatttatctatcttatcaatataagctttttgaacttgatttatttttgatgaatcaattaccaaaatagcttgctcggttttctccattgctttttgttttgtttttacttcatcaaaattaaagcaagttacgcctttatttacatcaatccctgcagctgagatgaacgcttttgttgtgcaaattgcatccagttcattagttagctgaataggaattaaaaaagagttattctttgaataatttccaccgcacaaaatgacttcacaatgaggtttatcctgtagcaccataaaggtattaattgaacagcaaagtgcggtgaatttaatggcaggatcgatttgtgaggcgacgaaaggaattgttgaaccacagtcaaaaaaacacacatcgccgtctttaatgaaattagccgcaatgcgacccacttccattttttcggcaatatgctttgtttcttgctcaaaaatttggtagctgttatcggtgtttttttgtggatttttgacaatatagccaccaagtaaaacaactgagcctgtatctgaagccaaatcacggcgaattgtcatttccgatacatttaaaatagtggcggcatcacgcaagtgaattttatccatttgtttgagcaaaaagtctaatttttgaatgcgtgattgtattttcttatccataacaggctctattaattaaaacggttaataaatagcgttattgtctgttaaaccgttaataatagcaatccctgaacttgatccaattcttgtcgcaccatttttaatcatttcaattgcggttttagtatcacgcacaccacctgaagctttgacaccgatattttctccaaccacttgacgcattagtgcgatattttcaaccgttgcaccgcctttattgaaaccggttgatgttttaacaaatccgacccccagctcacgacaaatcttacaagcagtgataatttcctctttggttaacaagcaagtttccaaaataactttaagtaaagcaccttcacaagcagctaaaacagcttgaatgtctgcttttacggattcccactgatttgatttaatccaaccaatgttaatcaccatgtctatttccgtagcaccggcttttattgcttctttagcttcaaaagcttttacagtagataaattagcacctaatggaaatccaactactgtgcatattttaacatttgtattttgtaatttttgtcttgctagcggaatataacctgaattaatacaaacagaaaaaaaattatgttcaatcgcttcgttacaaagatctagtatatcctgttctgttttctccgcagttaatgctgtatggtcaatgaattgagcaatgtcataagattgcataaatatcctccttattttaggtttatgtgattattttcacttttttatatgatactgcaaaaaaaattaaaaactgtgactttgatcacttttttaacatttttaattttatatactgaataaaatgaattttgtgagaattataacatttattacggagaaaaacattatggatattgcagtcattggctcaaatatggtggatttaattagctatattaatgatatgccgaaaatgggtgaaacgctagaagctcatgattttaaaatgggttgtggcggaaagggagcaaatcaagctattgcagccgctaaattaggtgcatcagtaatgatgatgactaaggttggtgatgatgtatttgcagataatactattaataatttcaagcaatatggtgtgaataccgattttgtcgaaaaagtggtgggtgtatcgagtggtgtagcccctatttttgttgatcgttcttcacaaaatcgcattttaattattaaaggtgcgaattcttacttgaaaccggcagatattgatcacgctgaagttcagttgaaaaactgcaagctgcttattttacaactggaaattcctttagaaacagtttattacgcaattgattttgccaataaacatcaaattccagtcattcttaatcctgctcctgcaagtaaggaattagacattagttatgcttgtaaatgtgatttctttatgccgaatgaaactgaattggaaattctaaccggtatgccagttgataatatggaacagattcaagcagcagctaatagcttatttttgaaaggattaaaaaatctgattgtgactttaggcgaaaaaggatcggtttggtttcatcgggatcaggtaacacatgtctcctcgcacaaagttaatgctattgatactagtggtgctggagatgctttcattggttgttttgcacatttttatatacaaactaatgatgtcaaacaagcaatgcaaatggcatcagcctattcagcctatagtgtaaccggacaaggtacgcaatcttcttatccggataaagcacaattcgaacaatttctacaatcgttaaaataaggagtatggtatgaaaaatattcaacaaatgcccgatggttatctcaataaaacacctattttccaatttattttgctttcttgtttattcccactttggggagcagcagccagcttaaatgatattttaatcactcagtttaaaagtgtatttacgctgagtgattttgccagtgctttagtacaaagtgcattttatggaggatattttttaattgcgatacctgcatcattggtgatcaaaaaaaccagctataaaattgctattttaattggcttaatgctatatatcggtggttgttcgctattctatccagcctcgcatatggcaacatacacaatgtttttagtggctattttctctattgcgattgggttaagtttcttggaaacctctgcgaatacttatagttcaatgattggacataaagatcatgcaacgttgagattaaatataagccagactttctatccagttggtgctatttcaggtattttattaggtaaatacctcatcttccaagaaggtgccagtcttgaagaacgaatggtaggaatgacaccggaacagttgcattcatttaaattatcaatgttagaacatacgttgtcaccatataaatacttaatcttcatattgattgcggttacttttttattcgtaattacctcttttcctaaatgtaaagcagttacacaaacaggtaaatcagaagtgaaatttaccgatacgctaaaatatctagcaagcaatacaaaatttaaaaagggaattgttgctcaatttctctacgttggtatgcaagttgccgtatggtcatttactattcgtttggcactcaatttaagtgatatgaatgaacgtgaagcctcaaattttatgatttatagctttattggattctttattggcaaatttgtcgctaatttcttaatgactaaatttaagtcagatctcgttttactttggtattccattttaggtgtgatcactctagcttatacctcttttgttcatgatttttctgctgtttatgcggctattttcgccagtttgttgtttggtccttgctgggcaacaatctatgcctcagtactggatactgttaatcaagagcatagagaagtgggtggggctgttgtcgtcatgtctattatcggtgccgctgttgttcctgcaattcacggttatgtctcagatacattaggatctcttcaacttgcatttattgtacctttattctgttttgcttatgttggctattatttttatggaaaattaaaagaaaacaaggagaaatagtatgaaaagctacctttatttatctaaatcacaatttacagataaagaacaacttatttttaaaaatgaaaagctaagtgcggtcgcatttcaatatcaatccggtattgaggcggtcaaactgatcaatagtaaaggttttgtaattgttttacctttttatgggcaaatcatttgggacgttcaatttaacggacaaactctcacgatgaaaaatatgttcaacgaacctaagcggggaacaactattattgatacctacgggtgttttgctttccattcaggcttaattcgtaatggttgcccaagtccaaaagacgagcatcctttgcatggtgaaatgccttgtgccgtaatggataaggcttggttgattattgaagatgacaaattagggattggtggtgaagttgaatatgtgaaaggtttcggtgagcattattcagctagaccggaggtgatattatctgctgacagtacattatttaatatcaatatggcagtgacaaaccttgccagtgttgatatgccgttacagtatatgtgtcatatgaattattgctatgaacatggtgcaacattcagccaaaatatccctgaaagtgcggtgcaattacgccaaactattccggctcatgtgaaaccgacaccgcaatggctatcgtttaatgaggagattaagaaagggaattatacactgtcatcgttggaaaatgatgaaatgtataatccggagatagtgttttttatggataatttgcaacaatatcagtcacaacttgaatatcgtatgcactccccgaaaggtcataattatttggtaaaattctcgtcagcacaattcaattatgcaacacgctggattttatataatgccgatcagcaagtgggtgcttttgtcttaccagcaacctgtcgtccggaaggatttttggcagctcaaaataatggctcattaattatgctaaaaccaaaagaaatgcggtattttagtgtcataacaggtattgaataacatatagcaaacaacataaatgcggttgacaaaagtttaacggtattgctaaatgcatatttagttaaaatatcctaatgaaatgtttaaaaaaattggcttttataaaaatctcttgtataatcgccggaccctgtgaatgtgtcggatttcccaccgcacattattttatcaagatcacactcgaaggggtggagattaagattgatggttgtgcttaagtttaataagcactgggtattaatattattttattggtaattaattaatgaaaacttttgtagcaaaaccggaaacggttaaacgtgactggtatgtagtggatgcgacaggtaaaactttaggtcgcttagcgactgagttagctcgtcgccttcgtggtaaacataaagctgagtatactccgcatgttgatacgggtgattatatcgttgttatcaatgcagaaaaagttgcagtaacaggtaataaagaaactgataaactttactactggcatactggctatgtaggtggtattaaacaagcgactttcaaagaaatgattgcacgccgtccggaagcagtgattgaaattgcagttaagggtatgttgccaaagggtccgttaggtcgagcaatgttccgtaaattaaaagtgtatgcaggttcagaacataaccatgcagcacaacaaccacaagttctagatatttaatcacgaggttaggaaaatggcagagaatcaaaactacggcacaggtcgccgcaaaagctcttcagctcgtgtatttatcaaaccgggcagtggtaaaattgttatcaaccaacgtgagttggacgtatatttcggtcgtgaaacatctcgtatgatcgtacgccaaccgttagaattggttgaattaactgataaattagatttatatgtcacagttaaaggtggtggtatttccggtcaagcgggtgcaatccgccatggtataactcgtgcattaattgagtatgatgaaacactacgtcctgcattgcgtgcggctggttttgttactcgtgatgctcgccgtgttgaacgtaagaaaatcggcttacacaaagcacgtcgccgtccacaatactcaaaacgttaattttatatacaaaattgcaagccaaatggcttgcaattttttttcttattttgtcagtaaattatgatggaggcttatgcattgccttttcatttatggtaaaatgaaaagtctttattaattttcaagtcgtcggaggaaaagatgacaagtgctgcgaataaacgttcaataatgactctttttttagataaggttgatatttattgccatcaggttcgtattgttttagctgaaaaaggtgttgcttatgcaacagaaatagttgattctgaatctatatcagaagatttaatggaattaaatccctatggcacaattcctactttggttgatcgtgatttagttttattcaactctcgtatcattatggaatatttagatgagcgttttccgcaccctccattgatgccggtttatccggtttctcgtggtaaaagccgtttattaatgttacgtattgaacaagattggtatcctgtattagaaaaagcagaaaaaggttcagagagtgaaagagctattgcattgaaacaattaaaagaagaaatcttggcaatagcacctgtatttagccagtcactttattttatgagcgaagaattcagtttagttgattgctatattgcgccgttattatggcgaatgcagcaacttggtgttgtatttacaggcacaggcagtaaagcgattaaatcttatatggagcgagtgtttcaacgtgattcatttttacaatctgttggtgaaatgacacctaaaaatttaatggaggataaataggattaatatgtcgtataaatttttacctaaacgtccctatttattaagagcctattatgattggttgattgataacgacttaactccttatcttgttgtaaatgcaacttattcaggcgtaaaggttcctgttgagtatgtcaaagatggtcaaattgttttgaatttatctgcaaatgcgacaggtaatttattgctgaataatgaggcgattcagtttagtgctcgttttcagggggtatctagagatatttatattcctatgggagcggcattagctatttatgcacgagaaaatggtgatggagtcatgtttgaaccggaagcattttatgatgaattaaatattgacagtgttgatgaacagcctttaggttttgctgaagcagttgatcaaaagaaagtgaaaaagactgaaacaaaaaaccaaaaaggaacatcacatttgcgtattgtgaaataaactaaagcaattttttgaaccgcacttaaagtgcggtttttttatgaaaagtaatttaatcaattcttgtatttagaaatttgcattacgaggtgtgcgagggaatggaattacgtcacgaatattttgcacgcctgtaacataaacaattaaacgctcaaaacctaatccaaaacctgcatgtggaactgttccataacggcgtaaatcacgataccaccaataatcttcagcttttagtcccatttctgctatgcgtttgtcaagcacttctaaacgttcttcgcgttgagaacctccgataatttcaccaattccgggggccagaacatccattgcagcgactgttttaccatcatcattcaaacgcatatagaaagcttttatatctttaggatagtttttaactacaaccggcgatttgaagtattcttcggctaaataacgctcatgctcagaagataaatcaattccccaagatacaggaaattcaaacgctttgccggattttaacagaatatcaatcgcatcagtatagtctatttgagcaaagtctgaattgatgaaatcttttaagcgagtaatcacgtttttatcaacatgcttttcaaagaattttaagtcatcttcacgttcatttaatactgcacggaaaacatatttcagcatatcttctgctaattttgcattgtcagctaaagttgcaaaagcaatctcaggttcaaccatccaaaattcagctaaatgacgcgttgtatttgaattttctgcacggaatgtcggaccaaaagtatagattttgcttaatgcacaagcataactttcaccatttaattgacccgataccgttagaaaagactctttaccaaaaaaatcttggctaaaatcaaccgcacctttatctgtgcgaggcagattttctaggtccaaagttgatacacggaacatctcaccggcaccttcagtatcagaagctgtgatcaatggtgttgctacccagtagaaaccttgttcatggaaaaaacgatgaatagcttgagctaagcaatgacgaacacgagctactgcaccaatgatattagtgcgtggacgcaagtgtgccacttcacgtaaatattcgatactatggcgttttgcagacattggataagtttcaggatcatcaacccaaccggaaacttcaattttgtcggcttgtaattcaacagcttgtccttcagcaggagactcgacaatttttccagtgacaacaacggaacaaccggtagttaaacgtaaaatttccgtttcatagttttcaatatcattatttacaatagcttggataggatcaaagcaagaaccatcgtaaatagctaagaaagatagtcctgctttagaatcccggcgagtgcgaatccaaccacgtactgttacagtttcaccgaccgtgatttttccttttagaatattagccacagatgcaatttttgtcatataaacctcaaatcagtttttataattgtaaaacttagtcattttaccgtaactcattaaaattaccaaaatgtatcggaactttttgtttttgtgagatagcacacataatttatataagtcccttgtttattaggaaaatttcttggtataaatgaacaattttatgaattaaaataatcaggtagaacaggtagaaaatatggcaaaagtgagaaaagaggataaattacctctgagaatgaagcagctaggcaaaatttatcgcttaattgaacaatttgaagaaatttcacgtattgatttatccaagttatctcaactggctcctgcaactatcacctccttaactagagaacttatagaaaaaaaattggtgattgaaagagcggtacaaaatacggaaaatcgtggtcgtccggcagttggattatgtgtctcaccattttactggcaatctctttgtgcaacactgacatacgatcattttgatattttgctatgtgagctggatggcacaacaatagcccaagaagtttatcctcttgatctttctgatttatcttcattagaacaaatgttgccttgctattttgaagattttttatcaaaagttgggactaaattgagtcgtccgattactttttctattgcagtggcgggtaaactacaccatttgtctggttttctgcaacgtttgggggagatcgaattaaatgtggatctaacatctttatttgcaggctattttgatataccgattattgtaacggaatattttgaaacttggttattagcggaaagcacattaggaagcgtaataggatatgatgatgtgattttcttgcaaattgatgaagtcattaatttgagtgttttatcaaaaggggttattctacagagtgatcataaaacttgtatgaatattgaccaaatcattgttcctcgcctgtatccaatgcaagataagatcaatcaacatttatttgagcttgagcgatatcaaatacataatcaattgacttataaagcattttgtcaatttatagatctgtattatccaaataataatttaattaacacgacagaaaagatcaattttttatgtaaaaaagcacagcttcaagatcctttagcattagaaattttagctaacatagccgatattattgcatacatcttatccaatttagttaatcttttttcacctgagaaaattatgtttacttctcgtttgctatccgtcaaacatgttttccttaatcaaataaatcagcgtttagcacattatttgcataattcaaaaatatgtgaagtaatgacgagccagtatgaatggaatagtcatgaagttattgctgctgctattaaacaaaagatttatgatggtagtttgttagtttatatggaaaaatattaaaatttttttcacttagctgtcaaaaaggcgttagaaagcatttttgattgcttgactataaataaaggtttcagctgaaagtatcatagcaagacttttaacttttaagagttaaaggcttttggggtagcgaatttacgcccccagctcttttgaaatggattgtgctgtttgtttgagatgcatgagcaatatatctttgccgatttggtttaaacgtgcagttgatagagaaattgatacggagtagattacattgctattgatgtcaaatattgggcaagctaaacaagttacgcctgtttcattttcttcattatctacggcataccctaattctcgaatcttatttaactccagctccatagcactcagtgttacaattgtattagctgttaattttgtaatattcgtttgatttttctcccaataatcatctagaatgtgtcttttttcgtatgccataaaaatttttcccatagctgaacaataaagttctaaacgctgaccaatatacgctcgtgtacgcatcatacctgttgttggttcaagtttataaatcattacagcatgatgatgatcacgcatagataaattgactgtttcacctgtattcaaattaagttgctctaagtaaggggatgtaatatttaatatattaagtgaactcaaggttttttgcccaatcgttaaacacttcattgttaaacgatatgtaccaattgtattggtaggtttgacataaccacaggtttgtagtgtttgtagcatacgatatgttgtacttttatttagattagataattcagatagtttagctaatggacaaccattagggaaattgctcaaaatatcaattagtaataaacccttaattaaactttggttgctgctagcttgtttatttttattctcttctttcattttttattcctaaatagcttttttggttagttttattttagtgatatatcgataaaataaaaatgagatcttgatcacaaaaaataaaaaaatttatatctatatgatttataaaaacttttatttcttattttcatttgcatacaaattttattcagactataattttttaaaatatcgtttcaatatatgaaataaagattggcgtaatgaggttaaaacatgaaagtcagctacgaaatactcaaacaagaatttaaacgtatattacttgcaagaaatgttcgtgaagacattgctgaagaatgtgcgactatatttgcagatacaactgagtcaggagtatattctcatggggtgaaccggtttcctcgttttatttctcaactggaaaaaggagatattgtaccggaagcgattccgactaaagttctttctttaggtgcgattgaacaatgggatgctcatcaagcgattggtaatatcacggcaaaaaaaatgatggatcgagccatggaaattgcggatcaatttggcattggcgttgtagctcttaaaaatgcaaaccattggatgcgaggcggtgactacggttggcaagcagctgaaaaaggttatataggaatttgctggactaattcaattgcagtcatgccgccatggggagcaaaagaatgtcgtattggtactaatccattgattattgctgtaccgaccaaccctataacaatggttgatatgtcttgttctatgtattcttacggtatgttagaagttcatcgtttagcgggtcaacaaacatttgttgatgccggatttgatgatgaaggtaatttaactcgtgatcccggtactgttgaaaaaaatcgtcgcttattacctatgggattttggaaaggatcaggtttatctattgttctagatatgattgcaaccatactatctaatggtttatctgttgcagaagttaccgaagaaaaagatgatgaatattgtgtttcacaaatcttcattgctattgaagtagatcgtttaattgatggtaaaacaaaagatgagaaacttaataaaatcatggactatgtgaaaacagctgaacgagtagatgctgatgttgcaatacgcctaccgggtcataaatttgcggcagttcgtgctgaaaataaaattcatggtattccggtcgatgattctgtttgggaaaaaattaaatccctataacctataaggaatacttgttctttggtcattgttttgatcaataatcaactaaacccgtaaagtggttattaaaattacggtaaatgtgaattagaggtagcatgatgacatcgattagtttaaccgtaactaaactattagaagcattggttgttattattttagcaacgatgtcttgcttggtattccttaatgtcgtactacgctatggctttaatagcagtatcaatattacagaagaagtttcacgctacttatttgtttggttggcatttcttggtgctatcttagcctttaacgaaaatcgtcatgttaatgttacgatttttatcgagcgtttatctcagcatcagcgaaattttctacgcttattaacggacagcctaatgttgttttgctgttatcttttaattacaggtggctggatacaatttcagcttaatctaactaatatggcacccatttctggtatcccaacaggtattacttatttagctagttttattacaggcttagttattgccatactacttatcattcgacttttttctaatgctggtgctttgataaaaggagaaaacaaatgacggttattatctttctttccactttattaggaggtattttattaggtattcctgtcgccttttctctgttattgtgcggtatagcattaatgttgtatttagacttatttgatgcacaaattttggcacaacaaatcgtgagtggtgcagatagtttctctttaatggcaattccattctttatcttagctggtgaaattatgaatgaagggggattatcaaaacggattattgatttgccgatgaaattagtaggacataaacgtggaggattaggttttgttgcaattcttgctgcgatgattatggcgagtttgtcaggttcggctgttgcggataccgctgcggtggcagcgatgctattacctatgatgaaaacaacaggttatccgttggatcgttcggctggtttgattggtacggctggtattattgcacctattatcccgccttctattccgtttattatctttggagtctctagtggtgtgtctattactaagctgtttctagcaggaatcgtaccgggaatcctaatgggaatttgtttagctgtcctatggtggtggcaagcaaagcaccttcgcttaatgactttttccaaggcaagaaaagaagaactttgtgtttcctttaaaaatagtatttgggcattaatgttacctgtaatcattattggtggtttccgttctggtatttttaccccaacagaagcaggtgctgttgcagcattttatgcattatttgtcgcactctttgtatataaggaattgaaaatcaagcaactttatcaagtttttctcgcggcggcaaaaacaactgcggtagttatgtttctcgttgccgctgctcaagttacaggttggttaatcacgattgctgaattaccacatatgatgacagcattgttagagccactaattgatacaccaactttattacttattgtcgtaatgctatttgtttttttgattggtatggtgatggatcttacgcctactgtattaattctcacaccggtattaatgccattggttgaggaagcaggaattaaccctatctattttggtgtgctctttattttgaatacttcaattggtttaattacgccaccggtaggtaatgtccttaatgtcattacaggtgtatctaaattgccatttgatcaagtgacaaagggcatacttccttatttattgatgatgattgtgttgctctttatctttattttcttccctgctttaattttaatgccacttaattggttacaactttaaatcttcataggagaacattatgacactattaaattttaaaacgctttctgtgttaatcgctagcatagctctattctcaggtaataccaatgctgcaacgacattacgttttggttatgaagctcctcgtggtgatacacaacatgaagcagcgaagaaatttaatgaccttttaaaggaaaaaacaaaaggagaaattaagttaacactttttccagacagtacgttaggtaacgcacaaactatgatcagtgctgtacgtggtggaacgattgacttggaaatgtcaggttctccaaatttttctggattagtaccaaaattaaatgtgattgatattccattcattttccaaaaccgcgagcatgtatatgccgtattggatagtgaaattggtcaaagtttattaaaagaattagaagccaaaggattaaaaggtttagctttttgggaagtaggatttcgatcttttactaactcaaaacatcctgtaaaatcccctgatgatattaaagggttaaaagtgcggacgaaccaaaatccaatgtatattcaagcattttcaatcttaggggcaaatccagttccaatgccattatccgaactttataccgcacttgaaacacgtgcggtagatgctcaagaacatcctgttggtatagtttggtctgctaaattatatgaggtgcaaaaatacttaagcttaactaaccatggttatacgccattgattgttgttatgaacaaagccaaattcgatgctctgtctccggcattgcaaacagcattagtcgaagctgcacaagaagcaggtgcttatcaacgccagcttaaccttagaaatgaaaaaagcattattgaaaaaatgcaaaaagcgggcgttgaaattattgagcgtgttgataccggaccgtttagggctgccattgaaaacgaagtacgcaaggcattcattgagaaaaatggtgatgatttagttaaaaaaattgatgcattagcaaaataagtatattcaatgataagaaacagaatttttattaaattgaccgcacttttacttattccttattcggaaggaggagcttatgttggcaaatggagacgttccaattcttcagctacagcatatcatcaaacgattcggtaatcaggtagcggtaaatgatgttagccttaatattcaccggggagaaattgttgcattgctcggtgagaatggtgcgggcaaatccactttaattaaaattctggcaggtctctattctcgtgatgaaggtgaaatttattttcatcaacaaaaaatccaatcggcacaatctcttaccaataaaaataaacaacctattgcttttattcatcaagatttagggctggttgaatggatgacgattgctgaaaatatggcatttgtaatgggatttcctcgccgtttcggcttgattgattggaaaaaaattaatcaacaagcacaagaagcattggattttgttggtattcacctttctgctcaaactcgagtttttgacttaagtcgtacagaaaaagcgttattgaccattgctcgtgcgattgctgtcaatgctgagattttagtgttggatgaaccaactgcctctctacctgcaagtgatgttgaacatttattcaaggtgcttaatcgcctacgtaaacagggcgttggtatgatttatgtcactcaccgattggatgaggtcattaggctttctgatcgcattttagtcatgcgtgatggttattctgtggcagaaggttcgactaaagattatgatgtgaaagctctagtgaaggctattgttggtgaagaaacaagagaaaaacaacgtgaaccattgcctaaaaacacaccagaagtggtacggcttaacgaagttgttgttggtgataccggtcctgtttcctttagtttacatcagggcgaaatgattgcattagcaggattgcgaggtgcggggcaagaagagataggacgattattatttggactacgtaagttggaaagtggagacattagtttaaatgaatgtgcttatcatgccgagtcgccatgtgaggcaatttataaaggtgtagcacttgttgccggagaccgtatccgagaaggtcttgtcatgtcaatgacaaccatggaaaatctctttatcaatcctatcttaagcggtcattttccattaaaaaattatgcaagcaaaaaagaaaggtctgaatgttggtatcaattccagctctttgatattcggccgaaaaatttatttattgaggtcagttcgctttcaggaggtaatcaacagaaaattgtgcttgcacgttggatgcagctcaatacacctgtgctgattttagaagatccaactgcgggtgtagacgttggtgcacgagcagaaatttatgacttattaaatcaagccttgaaaaaaggtgttgcaattattgtgatttcaaacgattttgaagaaattgcacatctttgtaatcgagccttggtattcaaccgaggcgatatcgtgggtgaattattcaacgaacaagtcacatttgcgaatttgctggcactcgcttcggacgcatctgctaccataaattaattttcgtgtttttagaccgcacttaaacaataggagagcatcatggctcaaacaaatattaaatcaaccgctttagaacagcctgtatctattgcacgtgatgggttttgggcgtgggtttctcaaatgatcactcgatatgggttactctgcttatgttttttacttatcatacttttctctatgacaacagattcttttgcctctatgctaaccttacatgcgattttagaaagtaaatcaaaaattgcactactggcactcgcagcgacgacgaccatgattgtaggcaaaattgacttaaatgtaggctttggtattgttctttggcatattttagctattacactacaagttcaattcggtttttcatggcaaatggcgactatcacagtactcattgtggcagcaatttatggcttacttaatgggattttagttgcacttgctgacattgatagcttcgttgctacattgggaacgggaacggtattgtatgcaattgctttatggcattcaggcggtcgccaaattgtcggtgatttacctgatgcttttattgctattaacagtactgagatcttaggtattcctatctcggctttttatgtgttaatcgttgctattgtcatgtggctggtgactgaacacaccccaacaggacgttgtatgtatgctgtaggaggaaatcctaccgccgcttatttgaatggtatttcgattaagaaatatacgattgtgccatttattgtatctagtttaatcacagggtttaccggagttctcatcgcagcacaacagggtgttgggcaagcaagtgtcggaatggattatcttttacccgcactggtaggtgcgttcttaggcagcacaacaattaaaccgggtcggattaatgtttggggaacccttgttggaattgctattctcgctattggtatttccggtattcaacaattcggtggtgccttttgggtcgagccattatttaatggtgcaactttattattatctatcactatcgcaggttatgcacaacgtaaacgtttattaggtcaaaaagcagtacacaagaaagcagcaacaaaataatttgttgtgttaattacccactaaaaggagaaaatttatgaaacagttttttcattgtagtttaagtgtagtggcttctgtagtcgcactctcttttgccggcaacactatggcaaatgatccatttgtcgctgaagcaaaacaacaagttgctacagctactgctcaaaaaacaacttgggatggaccaacaacaggtccaaaagtacaacaaggaaaaaatattattttcattgcttctgatatgaaaaatggcggtgtattaggtgtaattgatggtatgaaagaggcaactggtgtagttgattggaaattagaggtacttgatggtgcgggatcagtcaataatcaactttctgctttaaaccaagcgattgctcgtaaacctgatgccattgtcattggtgggtggaatccaaatgtggcaaaaattccacttagtaaggcaactaaaaatggaatcacattggttgcatggcatgctacaccggaaccggggccaataaataaatataatattttctataatgtcacctctgattctgaccaaattgctaaactttcagctcaacttgctgtagcaaactcagatggaaaagcaaaagtggttattcttaccgattcactatatgaaattgcgttacgtaaagcgaatgtgatgaaagaaattattgaacaatgtaaagaatgtcaggtattagagttcattgatacgccgcttgcagatacctcaagtcgtatgccgagcctaacttttagtttattacaaaaatatggtgataacttacaatacacacttgctattaacgatctctattttgattttatgacaccgtccttacgttctgcaaacaaaggagaaatgccatacaacatttctgcaggagatggttcagttactgcctatcaacgtattcggaataataatcatcaatttgctaccgtaccggaacccctgaatttacatggttggcaattagtggatgaacttaatcgtgcttttgctggagaaaaaccctctggttatgtcactcctgctcacctagtgattaaagacaacgtggcatttgatggtgggaataagaacctttatgatccacaaaatggttataaagaagcctataaggcgatttggaacgtgaagtaatcaactattgtggtcgcaaaaaattgtcaaaaaagaccgcactttcctagtaaggagagtatatgttatcagctaaaattgaagtttatgattcacgcttttaccaattagttggcactgaagctagattagaagaattgtttgacaaagcgatttgggcagagggacctgtttggctagaaaaacagcaagctgttatatttagtgatgtcaaaggcaatacaatgtatcgctggacggctgaacaaggtacacaaatattccgacaaccatcacaatttgccaatggtaatgctgtggatgctgcaggtaatttgattacttgtgaacacggtcgtcgagctattagcttaacggatcatgcaggtaatattcgagtgttggtcaataaattagaaggtaagcgactaaattcacctaatgatgtagttgtgaaatctgatggaacaatttggtttacagatccaccttacggtattttaagtgatgcagagggcaaaaaatcgcctagtgaaataattggctgttatgtatattgctatgatcctataactgacgatatccatatcgcaacttttaatgtcatgcgaccaaatggtttagctttctgtgaaaatgaaactaagctagtggtagcagatatgtcagtagtcgagtttcaaagaacaggcttacaccatcttgtagtgtttgatgttattgataatcagttatataaccgtacaagcattgctgctatttcgccaggtattcctgatggattctgtattgatcacaacaatgtgatttattgtagctgtgaaacaggactactggttttgttacttgatgggacttttttaggaagaattttactagataaaaccgcttctaattgtacctttggtttagatcaaaaaaccttgtttattacagctactaatagtttgtattgtttaacctttaaataaaaagagccggtaaggattatagaaaataatcattaccggcttttagctttatatatttattgaggattaataattttgtttagctttagcctggtcaaccactacaggatcaatataataaacctcggggatatcttgcttattaatttgtttaattgcatgttcaattgcgacagcaacttgttttttcggtaattgatcaattgtattttgcattttgccttgtttaacgtattcaatagcgagaggaataccatcatagccagttataagcactttgcctgctaatcctgcattttcaaccgcagtaactgcacctattgccatattatcatttgctgcaaaaataccttgaatgttagggttagcagttaagatgttagtggttacatttaaagcctgttctgtttcccagttcgcagattgtgaagcaacaattttgatatcaggatattcagagaatgcttttaaagctccggctttacgttgttctccattatcgacaccaggaatcccctcaagtatggcaatatttccttttttacctatcgcttctgcaaggtttttagcttctaaataacccccattaaaattatctacgccaacatagttaaaatttaatccagcttttttagctgcttctgcatcaagtcttacatctaaatcaataattggaatccctgctttttgggccttttggaaagcagggataaaggcaatagaatcatttggtgtaacaataattgcatctactttttttgcgatcatattttcaactaatccaacaagttgttcagttgagtcttctttttccgcaacttgaattgtcaaatctacatttagttgtttagcagtttctttagcaccctgttgcatagaaatgaaatattcattgcttagtgttttcatcaataatgcaatttgaggtttttctgctgcaaaaagagaggtagaaatagccaatgtacttgttataagcattgctttgaatagtttagatttcataattgatctccagtgaatttgtagttaaaaattggtagcaatcctaaaataaaacttgtctaaaaactgtgatctagttctcaaaataaataaaactttaaaagtctattttctcagcttttaagtttatttactttgtgtgatacctatcacgattttattagtatttttatgttattcttaatatacagattgataaaaagggataattgctgtgttagatactttacctattctgtcacttagaaatattagtaaaaatttctatgacgtagcggttttagacaaaattaatcttgatatatattcaggcgaagtgcattgtttaattggagaaaatggagcaggaaaatctacgttatgcaagattatcgctggcatctataattcagatggtggcgaaatgttttttcatggtaaaatttattctcctcgtaatgtaaaagacggtcaaaaatatggagttggttttattcatcaggaactaatgctagtacctcaacttactgtactggaaaatatttttttaggaaaagaacatgcgaatttaggaaatcgcatggactggaaaataatgagagagaaaacactaaaaattattcgtgaattagaactcgatatacagccggatgatttagtatcagatctttcgattgcacaacaacaaatggttgaaattgctaaagctatttttagtgaatataaagtattaatttttgatgaacctacttcttctatatctcgtaaaaatacagaaactctttttagaattattcaccggttaaaagaaaaaggtgtagcgatgatttatatttctcaccgtttagaagagtttcaatatatttcagataaagttacagtattacgagacggaaatattactggcacgatgttgtataaagaaacatctgtagaagaaattgtcagattgatggttggtcgagaaattaatttaggacattatcaaagagatacaatatttacacaggaaaaattatgtgttgaaaatattactaataaaaaaattaaatcagcttcttttactgtgcataaaggagaaatattaggatttgcaggtttggttggagcaggtagaacagaacttttaagagcaatttatggagcggatgatgctaaaggaaatatttttatagataagttaaaagtttgcattagatcaccggaacaagccgtaaaacataaaattggatttattacagaggatcgtaaactacaaggtctcatattagatcagagtattcggaagaatataacattaccaatattaaatcgtttctggacaggaattagattagatcaagaaaaagaaaaaaatgtagcagagactcaacgtgatcgcttgagaatcgtgtctaacagtggtgaacagcacactagaactctttcaggaggaaatcagcaaaaggttgtaattgctcgatggttagaaagtggtgtggatattttattttttgatgagcctacaagaggaattgatgttggtgctaaatctgagatttatgacttgatgagagaatttacagacaacggcggtactatcattatggtatcgtctgatttacctgaattaatcacaatgtcagatagggtaatggtcatgaggaatggtgaaattgtagaagaagttaaagatcgttctagaattactgaagaaaacctaatgaacgctatggttggtgtatgaggtctaaaatggataacttaaaattaattttttcaaaattaggaattggtattgcattaattgtaatgattattggaatgtcatttgcatctgatgcatttttatcagctcataatattctaaatattttattacaagtttcagttatatgtattattgctgtaggtatgacttatgttattttaactggagggatagatctttctgtaggttctatcgttgcactaagtgccgtatgcttaggattatttactcatctaggtcttaagtggttaggcgatgaagtatcagattttgccgtattagcggtggttttaattgctatattagggagcgttttagttggtgcactatgtggatatataaatggaattatcattgtgtatggtaaagttacttcatttattgcaacacttggtatgatggggattgctaggggattggcactaacgatatcagatggaaaaacaatttataactttcctgatgctctgcgtttttttggtaatggaagaatacctatttcagattcgttttctatacctatcccagtaatcattgctattttggttgtgttggttagtttttatgtgctaacgcaaacgatttttggtcgtcaaatttatgctttaggtggaaatcgagaggcggttcgtttgtctggtgtaaatgttgagaaattagaagtcaaaacatatgcaattaatggggcattggctgcagtaggtgcggtaattttagtaggacgtttgaatgcggcacaacctatcgcaggtacaggttatgaattagatgctattgctgcaactgttattggtggtacaagtttgatgggtggttttggttcagttattggaacttcaatcggtgcattaattatgggagtactgcaaaatggtctgactttattagatgtgacgtcttatttacaacgcctaattattggtgttgttattattctagcagtattttttgaccaattacggcgtggtaaagtttcaataggacaattaaagcgtattttctttagagaataacttagaagatagtctaaatagttaataattttaattattggtatgcacagttatttgaataaatatattgcttgctgaaatttaggataaggaatagtgaaatgaattacacacttggtattgactgtggaggcacttttatcaaggctgcactctttgatacttttggaaaaatgattggttgcgtgcgtgaaaatgttgatgtgattagcgagcaagccggctatgccgaacgtgatatgtatgaattatggcaagtttgtgcaagtgtgattcgtaagacaattgaacatagccaaattgaacctagtaatatcaaaggtgtgggcatttctgcacaaggtaaaggtgcttttttattagataagaatcatcgacctcttgggcgtgcgattttatcttccgatcaacgttcacttgatatcgtgaaacaatggcaagctgatggtattcctgaacaactttatccaataactcgccagactttatggacaggtcatcccgtctcaattttgcgttgggtaaaagaacaccagccaaaacgttatgaggaaataggtgcggtattaatgtctcacgattatttgcgtttttgcttaacaggaaagcttttttgtgaagaaacaaatatttctgaatctaacttatataatatacttacaaggcaatatgatcctgccttggctgatttactaggtttatcaggcattattgataaacttccgcctattattgagtccaatcaaattgcaggctatatcacgcctgaagcggctactttaactggtttatgtgttggtacagttgtggttggcggattatttgatgttgtttcaaccgcactttgtgcagatttggatgatgaaactaaacttaatgctgtattaggcacttggtcagtgataagtgggatcactgatggtattgacgataatcaaacacttccttttgtttatggacgctatgcacaatctgagaaattaattattcatgaagccagtccaacttcagcaggtaatttagaatggtttgtgaagcaatggcagcttgattatcaacaaattaatcaacttatcggggagcttgaacctgctaccagttcagttttatttgttccatttttgtatggttcaaatgcaggattaggtatgcaagctggcttttatggtctccaagcacatcatacacaagctcatttattgcaagcaatttatgaaggagtactatttagtttaatgcatcatcttaatcggatgttacaacgctttccaaatgtgaagttattacgtgttacaggtggtccgacaaaatctaaaatctggttacagatgcttgctgatctcacaggaatgaaactggaagtaccacaaattgaagaaacgggatgttttggagctgcattgatggcgaagcagggttctagtgagtcaaccactgatgttttccaaacgcaaactatgttcagtgttgagcctaatcctatttatttcacagcatatcaaagaaaatatcaacgttatcaaaaacttatagattcgttaaaagcaatgatttaatgaggaaaaaatgacaaagccacttattcaacttgcactagatgaaacagatttaaacaccgcacttgttactgctaagcaagtagcagactcggttgatgttattgaagtaggcactattcttgcttttgcagaaggtatgggagcagtacgtatgttacgagcacgatatccaaagcatattttagtttgcgatatgaaaacaacagatgcgggtggtattttagctgaaatggcatttaacgcaggtgctgactggattactgtttctgctgcagctcatattgcaacaattgagagttgtaagaaaatagctgattactatcaaaaagaaattcaaatcgaaatctatggcaattggacattcgatgatgctcaagcttgggtcgatttaggtatcaatcaggctatttatcaccgtgcacgtgatgcggaaatagcaggtaaaggctggacggaagatgacttagtaacaatgaaaaaattatcaaaaatgggattatcgctctcaattacaggtggaattgtgcctgaaaatatctatttatttaaagatatcaatgctaaagcatttattgccggacgggcttttacaggtgaaaaaggaaaatttactgtagaaaaaatgcggttagaaattgataaatattggtcctaatattgcagagataaacatggagtatattgtgagaacacataaaatcggtatttatgagaaagcattacctaagaacctaagttggcaagaccgtttatccattgcaaaagcatgtggctttgattttgtcgaaatctcaatagatgaaacagatgaacgtttagcacgattagattggagtaaagctgagcgtattgaattagtaactgctattatttcaacgggcattactatcccatctatgtgcttatcaggtcatcgtcgctttccatttggtagccgggatgaagcaactcgccaaaaagcctttgagatcatgaaaaaagcaattcagcttgctgttgatcttggtattcgaactattcaattagctggttatgatgtgtactatgaagaacaagatgaaggaacaattcaacgcttccagcagggattggaatgggctgttaaacttgcggcaagtcaccaagttaccattgctgttgaaattatggatacacaatttattagctcaatcagtcgttggaaaaagtgggataatataatccgctcaccgtggttcacagtttatcccgatttaggtaatctttctgcttggaatgaaaatgtgagtgaagaactcaaattaggcattgataaaatatcagcaatccacttaaaagatacttataaagtgacaactactagcaaagggcaattccgtgatgtacctttcggtgcgggttgtgtagattttgtacaatgttttcgtaccttatctgaattaaattatcgtggtgcatttttagttgaaatgtggacagaaaaagcagaagaaccaatcacagaaattattaatgcacgtcgttggattgaacaaaaaatgaaagagggtggttttcaatgttagaacaattaaagcaaaaagtatttgaagcaaatttagcgttacctaaatatcatttagtgacatttacttggggtaatgtaagcggtattgatcgtgaaaaaaatctagttgtgattaaaccttccggagtggaatatgaggtaatgacgcctgaagatatggtagttgtggatttattcacaggtcgagtagtggagggcaataaaaagccttcatctgatactgctacccatctaatactttaccgtgaatttccaacacttggtggtatcgttcatactcattctcgtcatgctactatatgggcacaagctggggaagatttgattgctgcaggcacaacccacgcagattatttttatggtgctattccttgtacacgcaaaatgacacctgtagaaattcagggtgactatgaacttgaaacagggaaggtaattgtagaaacatttcgtgtacgagggattgatcctaaagatgtgcctgcggtattagttcattcacatggtccttttgcatggggaaatgatccggataatgccgtacacaatgctgttgttttagaagagattggctatatgaatttatttagtcgccaacttcgtcctaatttatcttcgatgcaacaagaattgctggataagcattacttacgtaaacatggtaagaatgcttattacggacagtaaatatgacataagtgctaaagtaaattgctttagcactgagttttagatgttattaagaatagcgtctaagacagaagcaattcccgctttatcatggtgtagagtgatcaggtttgcttgttgtttaatttcgtcctctgcattacccattgcgacacccagtccaactaatttaagcatagaaatatcattatggttatccccaaaagccacaacaaattgagggtcaatgtgccatgtgtttagtaactccaataatcttgagccttttgtatttccgctattggcaatatcaacacgatcaacccatgaccactcacaactaaacccaattgaagataaatgattaaccgcagtttgcatcaacgcacgatcaggatggctaattacaaatttccatatcgtttcctgatcatttaataacacattaaaatcaggaacatggcgtagtttgggatgtacttggggaggacaacgctgtacccattcggaaaatttacgcagatgctcattcattattgagtaattcattgtatcacgtgaatacattaataaatgtaaattgtatttttctgccagttgaatgacttgtcgggattgttctaaagagagaggatttgctgcaagtacggtatctgtttgtggttgatacatataggtaccgttacaacaaatcatgggagtagttaaattcagctcatggtaataaggataggcggcagtatgatgccttcccgtgactaaaatgacttttaagcctttatcaatacaacgttgaatcatgattttatttgacgttaaaatttgcccttggctatttaacaacgtgccatcaagatcaaacgcaatgacttggtatttcatcttttttcctattttgaatatcatctaattggtaaagtatagagctttttaagtccaaagggaatatattagtctttgcagggataggacaactgtataattctgtataggaaaattaaataaaactgaccgcacttttatgctcaccttataccgttacgatgcaattattttcaataagtacaatgatgaaatgtgttatgattaacacatttccagttttgatgtagagtaaattatgagtcaacatgaatctcacttcaatcattttgccttagccgaactgtatccttttgctacacaatttcctttgcaaaatataataggaaaaaaaggcatgcgaatcgtctatcgccattttgttcaagaacattgtgctgaacgtagattagtgattttggtcaatggacgtgcagaaaacttgttgaaatggacagagttggcttataacttttatcgacaaggctatgatgttttagtgtttgatcatcgtggacaaggctattctcagcgtttattaaaagagcatgacaaaggctatattgatgagtttcgtttttatgcggatgatcttactttgttagtggaaaaaattacttcgttgtatcactatcgtagccaacatattttggcacattctttaggcgctttaatcagcacttattatcttgccaatgataatcaccaaataaaaagtgcggtattttctgcaccattttatggtattccactgcagcattcattacgagatgaattcattattaatttaatgatgttgcttgggcagggctcacgctatgtatttggcaaaggtgagtataaacccgctgatttagataagaatgatttgagtctttgtcgtactagaatgaaatggatgaatcgtattaatcgtcgatacccacatattcatttaggcggaccaacttttcgttgggcatatgagtgtatgtatgccattaaaaaattacccgttgtcttaccccgaattgaaattccggtactagttttacaatcagaaagagaaaaaattgtggataaccaaaatctgcaaaaattgaccgcacttttgcctcaagctcaactagtgcagattgaacatagtaggcatgagattttatttgaacgtgatcgaattcgagatttagcactagcaaaaatcaatcagttttttactgaaaataacgccaaataaacacgcctaatgttgtaaaaaacaagcaaccgagaatatgtaacgatgtaatagttatgccttctagccatttatgttgaagcagattttcaataatttctgcactgaatgccgaaaatgttgttaaactacctaaaaatccagttacaaaaaataggcgatattcagttgaaaaagcagacgaatgccaaaacatagccagcattattcccataattaaacaaccgatataatttgcgattaatgtgccaaaggacaagaaagtaaacaacggattgagtaataatgtcaatccatgacgagacattgcaccaagagaagcaccacagctaattaagaataaatgtgtaaatagattcatatgtgtataataaacagaattaaatgatgttaaatagcgtgcagagatacctcgctaccgattcttgtgcgtttaacccaatgatttctaaattcgggcaagctgactttaaacgtggatcagcattgctcatcacacaacctttatcaacttgggttaacatttgtatatcattcataccatctccaaaagcaatacattgctgcattccataattccgctcggctaatacctgctctagtgcagtggcttttgatacattttgattcattatttctaaacaaacgggagttgaataagtaatgctgagtttatctccatatgtggttttgagagatgtttcgatattgactaagtcttgcggttcccggccaaggaaaaacactttttctgtagtttttccatgatgttgagcaaaattcactactttatacataaaaccggaatcttgatggtatttacgcaactgaggaacttctgtattaataaaccaatcatccccttgatatgaattaacacatacatgtgtacgatcaaaaggcaagttcataatttcaaatgctattgtttcaggaatgtaattgtggactaaaagattgccttgcaaatcctgtgctcttgcaccgttagaagtaatcattactgcatttttgatcttaattttttttaagattggtagcaaatccgtatggttacgccctgttgctaagataatatctataccttgagatgcaagcttttgtagtgtctcgatagtgaaatcgccaatcatatgattggcattaagcaatgtaccgtctaaatcagagacgatggcacgaaaaggaacattttgcatagcctatctttatcctatactgaaatcacagaacagattatttaacccaagtgacgatttcatcaagggatttacgggattttggcttaatttcttttgctcggtagccgaaagttgccattaccgaaactccccattcgtctgaatctaatacacctgcatcagttaaaatttgatttactttttcataattaaaaccttcaattggacaactgtctattccaattaatgcagcaccagttaacatatttgctaaggcaatataggtttgtttacttgcccagtcaaataaagtgcggtcattctcaagcgttttcatatgttctgcttgaaagagatgatatttttctttggtagcttgtatttgttcgccggataacccacgtcttttcatggattgtactaaaaattctgaatcatagcgtgcattctttttcgctaagataacaactaaatgactggcatcgtcaatttgagttgccattccccagctgacaggttttaattttgcccgtagttctggattttggattactaaaaaatgccaaggttcagagccgacagaacttggcgaaaggcgagcaaattccaaaacataagagaaatcttcattgctgatttttttatttggatcatagtaacgtgtggatgcacgacgattaaaactatccagcacgtgttcttttgaaatagtcgtcataataaatgtcctttaaatatttagcgaattgccatttggaataaaaccacttcagcttgacaaccaaaaacaatacgcatttttaaacgaaaaccatttgaaatgtcggtaatttgactctcaatatttgcagggtcattttcaatatcacgagctttctgaataaaataatcacgagcgttcaacgcttgtttttccgtatcgtattccgcttcaaaaacaacttctcttgcggaattatccagcattgaatcgcctttgatacggcacatattgtgtgcttctgccactttttgttgcaatgttttatcactcatgattatttccttatgcttaataaattaacctaccacactcggtaataaacctgcttgaactaggaatggaataatcacgataaatacaccaataactaatacagcgataagggaggctgagccaccttttactcgatacggtaagtgcgggtaaattttacgtaatttccataccattgcaataggtaaaacgattgcatagaatgcaaacatttgtcctgcatatcctaaagctagaataaatccttggggatagaatagtgcaaaagcaagtggcggtaagaaagtgagcagaccaactgaaacacgattagctgaaatatttactcgttttagcagatcttcaatcgcttcgaacaaacctaaggcaacacctaagaatgaagtaattaatgcaaatgcagagaatagacgaactgcaccgccaataatttcacttcctgtaattgtaattgttgctgtcaccaatccatttaaggttggatcttgttgtaagattgccaaaaattctgtttggcttagtacgccatgagtggctaattgccatagaatataagcaacaagtggaataaaggttccgactaagatagaaacgcgtaatgcctttacatcgccatcaaggtatttattcaggctgggaatagaaccgtgaaagccgaaagaggtaaagaaaatagggcttgctgagatgattaaggcattatcaattggaagtgcgagtaagttttctaaagagactttaggcagtaataagaaaagcactacaacaaagaaagcaattttactgaaaaaaatgatgcgattaatcttatctacgctatttgtgcctgaaataatgaaaataccgaaaagtacagtaaataatacacctgcaatccgagatgtggtttgttcatcgtgaatggtgggcaacagtcctgcgagtaaagagcttccgccggaaatgtaagctgaaactaaagcgtaaagaaaaattaacagtacaacagtagaaagaatacgtccgaaagatccgtaatatttttcagccaaagtcccaattccagcatcactgtctacagtctggtatagctcaacgaaaagtagggcggcaaaagagagtaatagccaaagcccgattaataaagtaagtgtaaagccaaaaccgattccggctgaggttaatggcatagcgagcatgccaccgccaattgttgttcccgctacaataagcgtacttccaagcgttttgttcatatttttctcccatgatgaaaataaaagtgcggttattgtaacttatatttttttaaaagtgtaattttatttttacaaaatgtaatattatatttacacatttgttttgggaaagagaattggcttaggatcttgatagaacaattgtactttttgtccaatttctaaggattgcattgtttgaatggtgatttgttgtacatcagatagagtaacttggtactgataatattgccctaaaaattgactttgagttattgtgccatgtccctgtaaagttggtatgacctgaatttgatgtgggcgaaccagccaatgtaactccgtattttgtaatagtggagattgatcagcaagtgtgagtaagttgtcgataggctgtataccaaagattgaatgtaattgattttgttgatcaatatagcaatcaatatagttatatttccctaaaaattcagccacaaatttactgttaggttggtaatagagttgatctgttgctccgacttgaataatttttccatctttcatcaatgcaatattatcggcaaaagcaaatgcttcttctttgctgtgagtcacaaagattgctgaaatgctttgttgtttcactatttgtttaatctcatcaatcatttgatagcgaacttggctatcaatatttgaaaaaggctcatcaagcaatagtagttttggcttgcatgctaaggctcgagcaatagcgacacgctgttgttgacctcctgacagttggtgagggtaacgatcttccagtccatctagatgaactaagttaagcatattttgcgaaatttgctttttttccatcgcactttttttatccaaaccaaactgaatattttctttgactgttaaatgaggaaaaagagcataatcctgaaaaataaaacctatgttgcgttgttctacagggacaggtgttaaatcttgtccatttaagtagatttttccttgtgtaataggctgtaatccggcgatggcttttaatagtgtcgtttttccgcaaccacttgctcctaataaacataaaatttcattttttttcaattctagatcgagttgatgtaagacaatttgttgtttgtattgacaactaagtgattgaattttaagactattcattatcgatccttttctgaatgtaaaatgagtgaacgagtgagccaaataacagggattaaaccaacgagaattaacgttaatgcaggcaaagcggcatgttctaattgttcatcggaagtaaaagaaaaaacataagttgctagggtatcaaaattaaaaggtcgcaataacaatgaggcgttaagttctttcatactttcaataaacaccattaaaagtgcggttaaaattcctttagaaagtaatgggaagtgtactttttttaacatttttatgccattagtacctaagctttgacttgccatatctaatgtaggaggaattttttgtaatgatgtttcaatacttccgagagccatagcggaaaagcgaatgacataagcggaaactaaagcaaacattgatcctgaaaaaattaatcctacaggagataaatttaactgagccagtatagcgttaatttgatgatccgcaaatgtgtaaggaattaaaataccgatagctaaaactgtacctggaatagcgtagcttaaactcgcaaagcgtaaggtgaattgtgcactacgttgtatgtgatttgaatgtagatttaagcgttggtaaaaatgtaaaagtagggcgaaaattacacaaacaattgaggcggtaatagaaactgacaaactgttataagcatattgtgaaaatttattgagctgtgattgttcaaaataatgaattgcccaataactcaattgtgcaacaggaataaagaaagcacaagtgactaatccccagcaataagtttgtactaaaaagccttttattccttttaatggcttaagtgcggtctttttttcataccctcgttgataggttttttgtttgtaacggctataattttccagcaacaagagactaaaaataagcaataaaatgaacattgagatttgagcagccgagccgagatctcccagtcctaaccaagtgtcataaactgcggttgttaatgttggcactgcaaaataagatacagtgccgaaatcgcccaaggtttccatcgcaactaaagcacaaccaatagcaattgcagggcgagttaaaggaaaaataattttttgtaataacttgcgtggtgagcttccaagtaatttagcactttgaattaaattttcgctttgttccaataaggctaaacgtactaataggaaaatgtaagggaaaagaactaaagcaagaacaatgcaagctccccataatgttctaatggaaataaaccaataatcttgtgcacttgaccatgaaaaagtttgccgtaaaaatacttgtacagcaccggcatagtctaataaatccgtataaagataagcaactaaatagccgggcatagcgagaggtaaacacaatagccattgtaagattttttgtccggtaaattgatattgagaaataaaccaagcacaaggcaaagcgaaaactaaactaaaagaaacagttccaataacgagaagcaaagagttgagcagataatcaaacagaacagtttgccaaagatgttgaatgttttgccaattgaggctccaagattgataaaaaatagcaatgatcggtgttacaaaaaacaacgtaataaaaagtgcggttaaaaaccaaataattttatttaatcttgaggaaaataaaaacattcgaaaactaattataaagtaatgtaaagtttaatggggcaattatagcataaactcaaagtcagtgagatcattaaatgcccagtttagaaacaggataaacaaagaaaaaagcctagtggatttagcatactaggcttgttcttttagcaaatattaaagatcgaatttgacttcatcaataagttttaatgctttatcgtagttttccgctattttatttagtggcagaggatctttcttaaatgttccccaagatttcactttttcagacggttcaacaccagcttttactggatattcatgattaagctctgcgtataaatgctgtgctttatcaccacttaaatattcagcaagtttaattgcattttctttatttggtgcatattttgcaatagcgataccgctaatattaacgtgagtaccttttgctttttggttagggaagttgatataaacagcctccgcccaagagcgttgtttttcatcgtctagcattttgccaaagtagtaactattgcctaaagaatagtcacatacaccttctttaattgctttaacctggtcacgatcgccaccttgtggtttttgtgccaagttgttttttagtccttctaaaaatgcttttgcttttgcctcaccatcatgagcaatcatagaagcaacaagagaaacgttgtaagtgtgtttaccagaacgcacacaaacttttccttttaattcaggttttgctaagtcataataagtgaaatcagcaggtaatttacctacacgatctttagaagtgtaaatcgcacgagcacgagttgttagtccaaaccattgatcattagcatctctatattgtgctggaatatttttttctaagatttcgctatgaataggttgtgcaagacccgcattcacaatttccatcacacgtttaatatcaacagttaataatacgtctgctggacttaattcaccttcacgttttacacgttcaactaagcctttattatcaaaaagaacattaactttaatccctgtttctttttcaaactcttttaaaattggttcaataagataaggttgacgataggaataaacattaacttcatttgcagctaaagcactggcggaaacggtcgctgctaaggctaaggttaatgtgctgagtgattttttcatgaaaactccttgtaagaataaatattaagtaaaggatacgaaagagctgtattagatactttaatagattaaaagtcaataagaattattcttgattgtgtaagtaaaattttaagttttatgaccgcactttacacaaaagggaaaataacttgattattttcccttttaattcaatttggtaaagcggttattgccaatattttttctttgaggtttgacctattcccggattgaaactatttgttgggtcaagggctttgtagaatttgcgtaattccggttttgcttgatacaaatgcccaacattatgttccgctggatattccgcaccacgctgatctaataaatcaagcatttggtgttccaattctgtacaattatgaccttttttaatgatatagtcttggtgaaaaacatggcacataaaatgaccgtaataaagtttgtgtataattttattttcaatttcagcaggtaatttttcaaaccattctttgtcattacgacgcaaggcaacatccaaagcaacgatatcttcaacatctttatcgtgaattgcacgataacgaattgcagccgaagcaacagcaaaacggtgtaacattgctgcttgagtttcttctgtattacattggaaataattacctttagatttatcggaaaaatactcttttaagtattcttgagcttcttgaacacctgtaccacctatttttacaataagatgatgttcatattggtcacggtattgccataaagatttcggtaaatgttccggcatcgcttttgataaaagttgcataaacttatcactgaaatcattgggtaaaaaactgacttttttggcgattcggtcaactttagctttcaaggcaaataatttaggtaagcggtgtgtgccaaattttttaataatccaaaaagtatctttaccgtatttggcggcaatgtcaaaagcatcacgatgaatatattcgccagagattggcaattgttggaaattagctaacatatgacgacgaatgtcgtttaatacatctgtttgatttgttccaatgtagaaaactgcggtatgtttttccatcggaaacgtatctaagcggactgcaaaaacagctaattttccggcactcccggaagtttcataatgtcggcttggatcagcgttaaatcttgctggagagttttcatcaatttggcgtacatgttcgcaataagaatgatcgtgtcctctgccacaatgttgttgaatatctttgcgttgataacgttggttttgtaaattttccaaaatttcttcaggatcattacctaagtcaatgcctaaatgatttttgagttccaattctccctgttcattaagttgagcataaagtgccatttctgtgtaagccggtcctctttgcaccaatgcaccgcctgaattattacatataccgccaataacagaagcaccaatacaggatgaaccgataacggaatgaggctcacgcccatgtgtttttaataaaatttccaattcatttaatgtcgaaccaggtaagcaaacggcttgctcggcattattgattagctgaataccgttcatatacattgtattgataatcacaatatcacgatcatagtcattaccgcttggtgttgatcctccggttaaaccggtatttgcggcttgatttataataattacatcggcctcaacacaggtttttaatacgttccaatattcaaccagattagtaggacgaacaacagcaatcgcatttccgttgccaaaacgatagccgctacgataactttcagttttacttggatctgtaataataaatttattgcctacaatgtcggtgagcttggaaataagttgttgagttgtcatcgtcataaaatgctcctttcttatttgaaaaaatcgacaacattataacaaatgaaagttgactagaaatgatgaaattctattcaattatacagtttttttgatgattaaaaagataattgagtttgagctaacaataaaagatgagttttgttgagaaatatgatacaaaagacaccgaatttttatttactcttaattaggaaacgatatgtcgaatttacaaaatattattgagcgtgcatttgaacgtgtagcagaaattaccccgacaaatgctgaagcagaacttagagcagcggtagatgaagcgattgaaggattagataaaggtatttatcgtgttgcggagaaaaatgaacaaggcgaatggattgttaatcaatggttgaaaaaagcggttcttctttcttttcgtttaaatgacaatgttgtagttgatggtgcagaaacaaaatattatgacaaagtgccggtgaaatttgcagattatgatgtagaacgttttaaaactgaaggatttagagccgtaccgggagcggttgttcgtaaaggttctcatatttctaaaggtgttgttttaatgccgtcttttgtcaatattggtgcttatgtcggtgaagggacaatggtcgatacttgggcaacagtgggttcttgtgcacaaatcggtaaaaatgtgcatttatccggaggcgtagggattggcggagtattggagccattacaagcaaatccaacgattatcggcgataattgctttattggtgcacgttctgaaattgtggaaggtgtgattattgaagaggggtgcgtaatttccatgggggtattcatcggtcaatcaaccaaaatttacgatcgtgaaaccggcgagattttctatggtcgtgttccggcgggttcagtcgttgtatcaggtagcttaccttccaagtgcggtaaatataatctttattgtgcagtaattgtaaaaaaagttgatgcgaaaacattaggcaaagtaggcattaacgaattattaagaactatcgaatagctaaaattcatgtagtttctattatctacctgcctcttaacataagaggcagattttttataaaacaatagttttattttgatacacaaaaattctgtcatgaagtgccaaatctaaagcctgcgttagtaccgctttttctacatcacgtcctgctttcatcattgcttccgcattataagtatgatcaacattaatgacattttgcataataattggtccctgatctagctcattattaataaaatgtgctgtcgcaccaataattttaacccccctttcataagcttgatgataaggttttgcaccgataaatgcgggtaaaaatgaatggtgaatattaatcactctattgggataacggctgacgaattcgggatttaaaacacgcatatatttagccaaaacaatataatctggagcatattcgtcaattttttcagctagtaatttatcatgttctactcgagttaatccttcatggcttacacaatgaaacggaatatcaaaacgctcgactaacgaacataaagtttcatgattcccaatcacagcagcaatttctacatctaatccgccataataggttttcattaaaatatcgcctacgcaatgtgcctctttggtaactaaaattacaatacgttttctttttgcatcaactaaacggcaatttgtaccattcggtaaactatagtctaaatcggcaagtaaagtttgttgattaaaaataccttccaattcagtacgcataaaaaagtgtttagtttcaaaatcaacaaattcattattatgaataatattgagctggtgtttgtaacaaatattagtaattttagcgattaaacctttatcatcaggacaatctgttaataggattttattttcaaccataataaatagtgatttattgtgttaagttaataaaaacttaagttagagatttatagcatgattaaatttcgaaatcagccaatgtttttcctgtatttaattcagcttgcagagataaaggcatacgcccctgacccgtccaagtttttactttaccattttgatctgtatattggtattttgctttgcgaggagctatttttttacgagggcgtttagtggtaaaggttggatcatcgactaaatcagtcaaggttaagccgtcttgtgctagcaatgctttatattttgcgatacgttccaaacgttcttgttcttttcgttgattttcttcaattagttgacgtcgttcatttgtaattaattgaaatttctccaatatactttctaactcttgcagagtgaattcttttgttgctacacgcaatgctcgaatactggttaatgtttttaataggtcagacatttttactccttaattttatattgataattcgctttcaaataataacgaaaaaatatttttaggtaaatcttaatttaaaaatagtctaaattttaattttatatattaatttaattattttacattaattatagattaatacttggaattttgattttcttattgtaatcttactcgctcctacatatgtagaggtgcggctgttataagtaattttttgagtggataacgatgaaaaaaatgaaaggaatagttgccgaaatcaattaaaagtcgttttaattggttgggggcgtattcgaaagaaacgtcactgtcatagtatttatccactatggagcgctactggttaggttggtatgggttattttgatcaccttattttaattatatttaaaatatcaatctcagtggttctcccttaaattaggaagaacaacatggaacttgtaaattattccacatctatttattcggttattccaccgatattagctttgctattagccattgtaactcggaaagtcattttatctttaagcattggtattattaccggtgctttaatgttgaccaaagatacatccatattggatagtattccttatttgtggaatcatatctccgctttggtttatagtattgaagaaaacggctcaatcgcatttgcgtgggacacaataaatattatcctctttttagttttacttggtattttgaccgcacttttaactgtatccggtagtaaccaagcctttgctgaatgggctcagaaacgtattaaaggtcgtcgtggtgcaaaattaatggcggctgctttggtgttcgttacgtttattgatgattatttccatagtttagcggttggtgcaattgcccgtcctgttacggataaattcaatgtatctcgagcaaaattagcttatattcttgattcaacagcagcacctatgtgcgttatgatgcctgtatccagttggggggcttatatcattaccttgatttcgggactattagcaacttatgccattaccgattactctccaatcggtgcatttatggcgatgagttcaatgaatttttatgcaattttttctattttattggtatttttcgtggcttatttttcatttgatattgggtcaatggcgagacatgaaagattggcattagagagaggggatacagaaagagaagttgaaatacaaacaaagataaaagggcatgtacgaaatcttgttttgccaatagtggtattgattgtagcaactgtggcaatgatgatgtataccggcggacaagcattaattgctgacggtaaagcatttagcgtgctgggtgcatttgaaaacacaacggtagggatttctcttgttgttggagggatagcctcagtagtgatggttactctctgtattttaactgatggtcagattagtttaaatgaatatattaaatcttggggattgggtgcaaaatcgatgtccggtgccattttaattctgtgctttgcatggacgattaattcggttgtgaaagatatgcaaacagggacatatttatccagccttgtatctggcaatcttcctattgcaacgttaccggcattacttttcatcctcggtgcagtgatggcattttccacaggaaccagctggggaacatttggaataatgctaccaattgccgcagaaattgcatcaaatgctgcccctgaattaatgttaccttgcttatctgcggtaatggctggtgcagtttgtggagatcattgttcccctgtatctgatacaacaattttgtcctctactggagcgaaatgtaaccacatggatcacgttacaacacaattaccttatgcgttaacattagcagtcgcaaccattgtaggttacttagttgttggcttcacattatctggcttattgggttttattgcttgtgctgttactttagctgctttagttttaattttaagaaaacgctaatatcgttttaattttgtttttgaaccgcactcataagtgcggtttttattagagcggagtttaaaataagtgtagaatggacaaaagttatcgttcatttcttatttaggagtaggagcaaaacatggcaattttagttactggcggtgccggctatatcggttcgcatacggttgttgaattgttaaatcatcatgttgaaattgttgttttagataatttatcaaattcctcggaagtttctttacagcgagtacaacaaattaccggaaaaaatatcactttttatcaaggcgacattttagatcgagaaatactacagcgtattttttcaacacataaaattgaagcggtgatccattttgctggattaaaagccgtgggagaaagcgtaaaaaaaccgttgcgttattatcaaaataatgtaattggttcgcttacgttactggaagaaatgctaaaagcaggcatatataacttagtttttagttcatcagcaactgtctatggagaccctgaaatcattccaattaccgaaacttgtaaagttggcggaacgactaatccctatggaacatctaaatttatggtagaacgtattttacaagacgcagtgagtgcaaatccgcacttgagtgttgtcatacttcgctattttaatcctgtcggtgcgcatgaaagtggtttaattggtgaagatcctaatggtattccaaataatttattgccttatattagtcaagtagcagtaggaaaattaccacagctttcagttttcggtagtgattatgatacacacgatggtacgggagtacgtgattatattcacgtagtggatcttgcaaatggacatctaaaagcactggagaaacaccaaaatgatcaaggctgtcatatttataatctaggcacgggaattggatattccgttttggatatggtaaaagccttcgaaaaagcaaatgatattcaaattccttataagctagttgaacgtcgttcgggtgatatagcaacgtgttattccaatcctcaaaaagcattagaaaaattaggttggaaaactgagcgagatttaacacaaatgatgaaagacacgtggaattggcaaaaaaataatcctaatggttataaatcgtaagtcgtaagtgagcgttttaacatacggataagacaattcagctctcaacatttcaataacaacagaacaacattgattgtttctgttgttattttaaacgatttagcaaaaaagataggcgataaatcgcaaagaataaacttttttctaaaaaacattttctttacatttaaagttaggataaaatcgcccgaataaattaataatacttgacaaataaaaatagaatagaaaaatgtctacagtctacagtctacagtctacagtctacagtctacagtctacagtctacagtctacagtctacagtctagtatattgcctaaaatcaacctttcaagttaaatttgggaggttggacatgttcaaacaatatcttaaaaatcacctatttcaacctcaacctttcggcgaaagtattattcgcctttttttgttgtgtcttaaaaagcaaggcatcgccgatttatttatcaatctatctaaaaagcaaagcgtttaattaatcaaaaaccgtaaaaaagttaaaaaaaatcaacaaaataaacaattgaaaaaaacattttaaaagcttaaagagagtgaatttatgaacaaaatcttcaaaaccaaatacgatgtaacaactggacaaaccaaagtggtgtctgaattagcgaataaccgccaagtggcgagccgtgttgaggcgacggagagtaagccgaagtgcggtgtgtttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagaaaactcaatcgctttaggaacgggcacaacagtaacaggtgcgggcgttgtggctatcggttccggcgttggtgtaacaaaagacaatacaatagctgtgggttatggagcattgggaaaatcaggagaaagtattgttttaggtaattcagcaacattagaagagcatgcctcaaaatctatcgtgataggtaatggtgcaaaagttgaaaatataaagaaagatgacacaattaaaaaactaagttggcctgaggatgaaaaatataggaagggtgaaaaagaattagaaatgtcggctattgcgataggaactagtgcaatagctaacgctcaaaatagtgtagcactcggaaatgaagctcaagtaagcatggaaaattcggtggcattagggaataaatcacatacaaaatatttctatcaagatgataataacaaaaacactgccacgctcagcggaaacggcaaaaatgatgcgattaatttagacccttatgttccagatgggtcaagttataayttmaraaccgatacarcsgcgggtatcgtgtcagtcggttggacaaaagatggcaacggcaaaacacaagagytgggyytragaaggattgtcggggtagcaccgggtgcgttggactctgacgtggcraccgtrggncarttaaaagccttgtattatgtgaaaaaagaaggtgtggtaacttactataccaaagacggaaataatattatcaaactcaccaaagatgctgatggtaagttttataragtcaacaccaaagacggcacgccttacaaggacttagaggaaattkmygcarawrawgttttcgtcggtccaaaaggggcgaatgaaaccacaagagaagaaatgattcagcggaaaaaatactctcttggcgacatgggtaataaaatcaaatttgctaatattttagatggcaatattgaaacaggatcagatcaagcgattacgggcaatcagcttnnnnnnnnnnnnnnnnnnnnnnnnnnnnnnnnnnnnnnnnnnnnnaaaacagaatttgagaaagtccaatttgatgcagtagatgtagctgatccaaaaaagaaaacgggaaaaatagaaaatttcaaagaagccttgactgactctatcgctgcaattaataraggytataaatttaktgmtgatgagataaaagataaagccaatgaaacrcctttytatttwggtkcwaccrttgwaatyaaancnggggatgttacaaagtcaggtacaacgacagagaactatctaggcaaaaacctaaaaacagaatttaaaaacgatagttcaaargcrwyattcaccatcggcttgaaagaagacccgagctttaaaaaagtcacgattgaagacaagattgaggataaagaagctaataaaaaacttgccgtcaacaaagagtatgtggataacaaacttmaaaaygtytcgacsaatttrcattwyttatcagtamaagggamkgataagaacgcaggcaactacaataacgatggagcaaaagcaaattattctgttgctattggggtgaatgctcaagtagtagatcctactactagtggagtgcctcctaaaaaaacaaaaccgacagcaacagcaggtatagcgataggatataacgctaaatctgaagcagaaaatgcggttgctataggtagagatgtaagtattgacgtaccgaattcttttgttatggggtctaataatacagttacgcaaagctttaaagagacaaatggtgcggttgttgtgatcggtagcggaacaaaattagtagaatcaaaaagttctatcgctatcggtgcggtgtatgtggaaagaggtgacaaaaaagatggtactgtaatagagaatgcggcttggacagcgtctatagggaataaaaataaaattaaaaacggtacggatattgttgctgtaggtaataatatnnnnnnnnnnnnnnnnnnnnnnnnnnnnnnnnnnnnnnnnnnaacaaagaatgcgaatacagaattaattctgattggtaatggtgcgacagcggaaactgcaaaagaaagtgtgcttattggggcaaaatcaaacgccggcaagggtgcaaaaagtgcggtgattattggtcatagtgctaaagcwgagasaracgccgtcggtgcagtagcgattggrcaaggtgcaacagtaaaaaccgccgccggcaactccattgccttggggcaaggstcasaagcgacagctaaagaagaagctaaaaaagacactactgtagctattgacggtaaaaatattaaatttaaatggacagctggtgttagttctagtagtggagataaaaaatccgttttaagcataggtaaggcaggtaatgagcgtatcattaaacacgtcgccgcaggtgcggtagataaaaattcaaccgacgctatcaacggaagccaactttacgctgtcgccgatgaattttcaaaattagcggtgaatgtattgggtgcggaaaaagccgacggygatacagyaggatttaaaaaatcgamwtttgamgtrgctaaatatcagggaagtacaamtrcwycarcacmaamagaaatgacctttaaagasgcaatygstcaaaatacaacagcgattaataaaggctttatttttggcgttggcgawsramstgrtgaawawggaacgcattayytaggcgataaattaaymatcaaagcgggagcaatcgataaaccgacgacaatcacgacatcagaagatggctattcgccgaataatattaaaacgcactatgaaaaaaatagtaaaaatatattaatcggcataaaagataaaccgacgtttaaaaatgtgattattgaaaatggtattcctgaagatgaggaagagcttaagaaaggtaattatgataagyatgctgtcaacaaaaaatatttagacaaaagattagaaaaagtcgccgctaatttcacggttaagggggataatyctaargmtggaraaggwtatacmttagataaagakcataatgaattaaatattaacggrgataryraaaayatcacaactgaagttgataaggaccataaaaaagtgagcataaaattaaaagatgctttaacaggtatcacttcaattgctaataatgatacaaaaattgagctaaaaaatggaactggtggaaatggaacaaaatctatcgttttcacagctggcgataacaataaatctgtaacactaaccggagataaattcagtggtgtgtctgaaattggaaaaaatgatcaggctaaaatcactttcaaaaataatggttcaaatgaaatagactttaaagcagggagtacaacctataaattcactgacagcggattagatttagccaataaaccaataacaaatctagcaagtggattagataatgttgtaaataatggtaaaaaagacttagacgaattattaaaacttatcgggacaaatgggcaaccaagcggatcttcaaatgatggcaaattaaacaaagcagtcaatgttaaagatttacttcatgtcgctaatgaattaaaaaataaagggctgactttccaaggaaatggtgatgatactgacaaagttaccagaaaactgggcgaaaccttaaaaatagttggagaaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaattcagtggcgtgtctgaaattagcagtaaagataataaatctacattaaaacttggtgctgataacgcaacggtagaattagctcatgacaaatcaaaacttgaattaaaagatactgaagcaacaatcacagctggagataatgccggaagtattaaaattacaagtaatggaagcaagacaattgaattaagtcctgaaaatggagctaaattaacacttgcaaaagatagcactactaatagtggctctagcaatgttaaagctactggcttatctcatgttgggttaaatgaccaaaacgctttaatctttaaaaatggaagtagtaatagcaataccgctgttttaaaagtaggtaatactgatttaacatttacaccaaccggaagtaatggaaatcaaaaagtccagatttcaggattatcaagcggattaactgatattggttcttctaccggtactagtggcaataatagtactcaaaaattagatgaattattaaaactaaaaccacaatcaagtggaacatcaaataatcaagacaaattaaacaaagcagtaaatgtagaagatttacttgatattgctcaaggcttggttgataaaggacttaaattccaaggaaatgacacttcaagcacaataacaacaaaactgggcggtactttaaaaatagttggagaaacagcaacttcaacatcgggaacaactgcaacaactcaaattaccaccgcacctgataacattactgttaagaaaaaatcaggtaatgacgatactttagaaatagggttatctgatgctttaaaaggtattacttctattagtggtaaaaatggcagcaatggaagtgcggtagcgaaaattgaatttaataryascggcacaggtggcagtgcttcaaccagcccaactgtcaaaatcaccgctggcggtggaacatttacctttggtgacaatggattagatttaggtaataaaaaaatcactaaacttgaaagcggtttaggattaacaaatggtactagtacaggtggagctggtggaaacggaaatgctgacattattaaaaaaatcctcgaaggaaatcctgacggcacgactggttcccctaaaattgccaacaacgccgtgaatgtgaaagacctgtccgaagtcgctaaagcgattgtgactaaaggcttgacctttgcagggaatacaggcgatgttaaagcctcactcggcgataaaatcacgattaagggtgatggaacgtatttgaccagcaaggcttcttcaaatggtggtaaagaaattgagttttcattgacggatagtacgaaaaataaagtcgatattatcaatgtcggcactaccaacaacggcgacaattcctttgcgttgggtaaaaattcaaaactagagacgaaaaagaccgcacctagtgaaattataccgaatgcaggaaaagatgaagtcaaatttagctggacaacagcaggggcttctaaaactacaaatcctgttgatatgaaagaagtcattagtgttggtgatacaaacgctgaacgcattattacgcacgtcgccgcaggtaaagtcgataaaggctcaaccgatgcgattaatggtggacaactaaaaagcgtaatcgatgtctttgctaatttagggataaatgtattgggtgcggagaaagccgaagctgacaaagacggctttaagaaaactacatttaccgaattgaaaaatacaagcggacaaaacggaacggctaaagacacatttaaatccgcwatcaaagctaatattgacaaaatcaacgaggggttgaaatttaaaggagatactaacaatggaagcaacggcgagcaacaactctacctcggttcgaccttgacgattaagggagcggaaaccaccgcacaaacatctactcaaggtgcgggtgcagccaaacatcaaaacattaccactaccgccaaaaacggtggcatattggaaatcgccctgaacamgawtttaaarggcattacctctatcgggaaagatggggataatgttttaacgtttaaaaatagtacaagtggtggaaactcagcggaattaaaagtcggtggagcgtctttaacattcactaaatcagatgatggtgacaaagtcaaaattactggcttggcagatggtgaaagtgatggcgatgctgttactgtcaaacaattaaccgcctcaaaattgcattatttatcggtaaaaggaccaaatggaactcaaaacggagacaattacaacaatgacggtgcaaaagcccaaaattctatcgccataggtgttagtgcaaaagtggaagatcacacttcacacgattccgttgctatcggttatcaatcaaatgtaataaatgctaaatggtcaactgccgtaggtgcaggtactcaggttaaatcaattcaatctttggcgttggggtatcaagcaaaagtattggaaaagagtgatgcttcaatcgcaattggtgtatctgatacaaaaatagaaaatgctaaatgggcggtggcattaggaaacaaaataacaatatcccgttccggtaataatgttgttgcaataggaagtaatattaatgtaggaagtggcaacgatgatttaatcgtaataggaaatagaggcgacagttcaccacaaataacaaacgccaaaaactccgtcattatcggcaaacaggcaatttctcaagcggaaagtgcggtagcgattggtaaaggagcgactattgaagccaatgccacaggtgcggtagcgattggggagggtgcttctgtctcagaagacgctggtgattctgtagcaataggtaaaaattcagctgcagaagcgaaaatgtttgcaccggacggaatagacgctaatgttggtagtcagtcgttgaaaatcaattggaaagacgcaggtgcttcagctacagataaagattataaatccgtgttcagcataggagatgctggtaatgaaagagtaataacaaatgtagcagcaggatatgtaatagatgggtcaacagatgcagtaaacggcggacagttatatagtgtgatacacacatttggtaatttggcaagtgatgtacttggtgcagaagttaatactgatacggataaggaggcagatggaacacctaagtatggcttcaaaaaatcaacgtttgttgcggtgaattataaggatagtacaaaacaagcgaaagacacattcaaaggtgcaattgatgaaaccattaccgccattaacaaagggctgaaatttgccggtaatactggtgaaaagcaacttcaactgggcgatactttagcgattaaaggtaaagaagatagtgcaaacagctcccataaaaacatcagcacagaagcgaaagacggtggtattttagaaatcgccttgaattcagagttgaaaggtattcaatccatcgctaatggtgataatgcaaaaattgctttggataaagacgcaaaaaccattaaatttacctcaggggatacaccgacagaggttagtttaaaagctagtaccttgagcggtatcactgagattaataaggcaacggacaagggggcgttaaaactcactgagaacagtgcgaccttagaaagcacgaaagacaattcaaaacttgaattgaaagacaaaacggcgactttagaaagtgcgaaagataagtcaaaacttgagttagcagaagacagtgcaacgttaagtgcgggtaatggtaaaggaagcattaaagttagcaatggaatatctaacaaaatcgagttaagccctgaaaatggctctacattggagcttacaaaagacacggcgaatggtaataaagtcaaagccactggtttatctacagttggtaaagatgagaryaacgctttagtgtttaaaaatggtacgagtggcacaagtggtacgaacacggcagagttaaaagtgggaggtgcgatgttaacatttacgccagtgaatgctaatagttctgataaaacagtgaaaatctctaatgttgcgactggtaatatagcgactgattcaaaagatgccatcaccggcagacaacttgccgatttagccactcacttaggrgttgctgttgatagctcaggaaaaactacgtttacagcaccatcatttaatgcgataaatggcggtacaactccaacaacctttaaagrkgckattrakcarttaatcaccgcsgtgaatggtggcttgacctttaaagggaatgatacttccccaasttcaaccacattacaattaggcggtacgttgacyattgatagctcgmctgttrgtagcggtgctactggaacgactgaaaaagacatcaccgtatcattagcaccaaatggtaacratgctaaagatgcgggtacacttacgctgaaattaaataaagcraymamrgtkgmcgamarcgatggaaaagttgtgacctctaaagcggtagcaacagagttgaaaaaatatacgacaacagctgatttagataaaggctatctcaaagtcgatggttctaatattggtgaagatgaagagaagaaaaaacaaggcagaaaaacattcggtagcaatgtcggtattgctgaaatcaagttagatggtgaaaaaagcagcactgaattagtacaggcggatgcggttatcaagtatctaaaaggtaaaggtgaaaaatcagttaaagtatccgataatccagaaactgaggctgaaggagtcggttctattgcgattggcgataaagcgatagcaaaaaatgaaggtgcaattgctatcggttatggtgctaatgctaaaaatagaaacgcacttgccataggcagagatagtgaggtattgggcgagcatgctacggctattggtttccaaaataatgtatcgggcaatcattccggtgcattcgggaaacaaaacacggttaaaggagagcattcctatgctgtgggtgcttataacgaaataggcggcgaacacacttatgtcttgggttcaagtgtcacgacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtacaccaacaaccactactacaccaccaacgacaacagctgtagtcaccattggcacgaaaaatgatttaaccaatatcacctcgatttcctctaaagctaaagctggaagtgcggacggaaatgatgctggtacaactggagacgtgactaaacttaccttagatcccactgatggggcgactttccaagtgggtagtcaaggtgcgaaagttaatatnnnnnnnnnnnnnnnnnnnnnnnnnnnnnnnnnnnnnnnnnnnnnnnnnnnnncgaaagatccatctgctaacgctccgtctattaccattaacgcaggttctgtaccagttgctccaaacagttcagcacaacctgctgatccaaacttgcctgctgttgataacggaccttctatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgagcaggtgtggctcaagctgttgcacaagcgaacttgccggtcaatatattaccgggtaaaagtacgttaagtttggcgaccggtaactatatgggtacgcaagcctttgcagtaggttattccagagtgtccgataacggcaaacttagcgtcaaattcagcttaggacatggtgataagaaaacctctgtgggtgcaggtatcggttatagctggtaattcttgacttttcatccatcaaaaaagggcgtttatacgcccttttttctattagtgtcgatattttttgtcaatctaaccgcactttttgtaaatactaaattaatttaagcaatacctttatgtcgcagtagtgcatctaattgaggctcacgacctctaaagcgtttaaatagaatcataggttcttccgatcctccacgagttaaaatttcatctaaaaatgaacgacctgtttccgcattaaaaattccttcttcttcaaaacgggaataagcatcggcagataaaacttcagcccaaagatagctgtagtatccggcagaatatccgcctgcaaaaatatgactaaagctgtgaggcgttcttgcccaatcgacacctttgacgacagctacttcagatttaacctgttttaaggtcgctaagatttgatttggtttattagcttcaaaataatggtgtaaacggaagtcaaataaaccgaattctaattgacgtaaaacaaacattgccgcttgaaagtttttcgcttttagtaattgatctaatttttcttttggtagtggcttgccggtttcataatgtcctgagatgaatgctaacgcctcttcttcccaacaccaattttctaaaaattgacttggcaattctactgcatcccaaggtacaccattaattccggcaacatcagcgacatcaatttttgtgagcatatgatgaataccatgtccaaattcatggaatagggtagtgacttcgtcatgggtgaataaagcaggtttgtcgccaatcggagcattaaaattacaagtcaggtatgcaacaggtttttgaattgaaccgtcagctttacgttttcgtccaatacaatcatccatccaagcaccgccacgtttattttctcgagcataaagatctaagtagaaacttcctctcacttcattcttttcatcaattaaatcaaagaagcgtacatctttgtgccaagtgtctacgtcaaaacgctctactgctcgaatattgaaaattcgtttaattaattcaaatagacctgaaataacttgatcttctggaaaataagggcgaagttcctcatcattaattgagtataaatactgtttttgtttttcgctataaaagctaatatcccaaggttcaagtgcggtgatattgtaatttttttggcaaaattcttgtaattcggtcaattctttctcgccttgattttttgaacgttttgctaaactttccaagaaatcaataacttgttgtggagtgtccgccattttggtcgcaagggaaagctctgtataagtattaaagcctaacaaatgagcaagttcgacacgcaaagtcaaaatttcttgcataacatctgtattatcccattttcctgcatttggtcccagttctgaagcacgagtagcaaaagctcgatacatttcttctcgtagttctcggttttcacaataggtcatgacgggtaaataactagggaattccaaggtaaaacgataaccatcaagccctttagattgtgcggattgttttgctgcttgtaatgcactttcaggcaagccaattagatcttgttcattttcgacgactttatcccatcccattgtcgcatcaaggacattattactaaatttagcgtttagttcagataaacgagcaacgatttcaccgtatctttgctgtttatcttctgataaggcaatacccgataattcaaaatcacgcaacgcattttctatcgcttttttttgtgcaaccgtatattgggtaaattccggactattttttagttgcacataggcattatataaccctttatgttgccctaaccaagtactatattctgaaatcagcggtaaacaagcttgataagcggcacgcaattcaggactgtttttcaccgcatttaaatgagaaacaggcgaccaagcacgaccaagtttttcctctttatcgtttaggggttgaataaaattctcccatgtaaagtgcggttgttttaacacttgttctaccgtttcacgattttgttggatcaattgctcaatcgccggttgaatatgttcaggtttgatttttgaaaattgtggaagttctgaatgagttaatagtggattagacataagtgttcctcaaaatagacagttattttatataaaaaagtggtaagtagattgggatttattctagaaaatcaaggttgaggtctaaaaaatgtgaataattgaggggtattttattaatagttcataggaaaatttttattttgttttcattttatttttcatatcttattttgtgtactagatcacaaaaaagaaaaaaagtaaattaaatattaaaattaataatttaaaagattaatttcaatagataaacttacttaaagttagaaaacaggggaattccatgaaagagttatctgtggattgtattattgagcggagagattgtcatagtgctaaatgggaattagcaaaaaaatatagtgaagatattattcctatgtcggtagctgatatggatattccttcacctagagagttaatagagtatttaggaaagttaaataaaaaagggatatatggatatactatttttcctaataattataaaaaaataattcaaaaatattttttaagacattatggaagttatatagatgaagaaagtatagtattttgtccaagaataatacaggctgtttctatttatatcagagagtttacatgtataaatgataatatatctattttatcaccttcttataaaccattggtaaatgcaatttctttaaataaaagaaatgcaattttatgtgatttaatatataaaaataatcaatactatattaattttgatttgttagaagattgctttaagaaatcaaaagtatttatatttatttctccacataatcctacaggaacagtatggagtaaaaatgatttggaaaaaatagccatgttagcagaaaaatatggcgtttttattatatctgatgatatacatgcagattttaatttttccaacaataagcatatttttatttcatctgttagtgaatatgttgagaataattctattatatgtacatccccgtctaaaacttttaatattcctggattagaaatatcaaacttattaataaaaaatacctgcattagaaataaatttaaacatcacttagaagcattgggatttcataatccaaattatttttctgcatctgcattaataattacatatagtaattgtgatgagtggagaaaagaattattggaatatattagagaaaatagatctttggtgaaagatttttttgaaaaagagattcctgagttagaggttgttaatagtcaagggacatatcttgtttggattaactataaaaaattaaatctaaatgaagataaattaaaatattggctcattaacttatctaaaattgaaatgtcttgggggtctgatttcttaagaggtggtgaatatttttttagaatgaatatagctatgccaagaatagttttaatatcttgtttaagaaaaataaaagaaggattaattttgctattagaggaatcaaattatggaaaataatatgaaaagaaaaccgaaattattagaggcattatctccaattttatttatgctatttttattggggtgcggttatgcattttttgatttgccaccagagcctttaatgattctttcatgtgtatttgcaggtattttagtgaaaaagttagggtattcttataatgatattttagattcaatttcatttaaaatatctaaaactatgcctgcattattaattttaattactgttggcttattaattggaacttggatcattggcggtactataccaatgatgatttattatggattaaaggtcattgatcctaaatttatttatattacagcattatttctaacagcaatagtatcaatttgtacaggaacatcctgggggtcagcgggtacagttggtgttgcatttatgggtgttgcaattggtttggatgccaatttagctgccacagcgggtgccattgttgccggtgcttattttggagataaactttcaccattatctgatacaacaaatatagcttctgctgcaactaatgttgatttatatgaacatattgctcacttactttacacaacattaccatcttttctaatttctgctttagtttatattgtatatggatttaatattaatattgataatgtagcaacacctgataaagtattattgatgatttcagggttagaaagtatttataattttaatttatttttattgatacctgtaataattattttgtggggatctatcaccaaaaaaccaacaattccagttatgttattttcagcagttatagcatcatttaatgcaatttttattcaacatttctcattaaatgatgttattaatagtgcattaaatggatttaatatctcaatgttacctgattctttaaatattagttcagatcttgcccgtttactgaatcggggagggatgaattctatgatgggaaccttattaatttgtttttgtgcgttatcttttgcagggatactttcacttagtggtgcattagatgtaatcattaattacttattgagattagtgagatcaacggcttcattaatttttattactattctttgtggtcttactatgattggtgtgacttgcaatgggcaaatttcaatattaattccaggagaaatgcttaaagatgcttacattgacagaggtttacatcctaaaaatttaagtcgtactgttgaggattcagctacaattatagagcctatccttccttggactgctgcaggggcttatatggctggtactttaggtgttgccacattaacttatttaccttgggcaatcctttgttggagcggtattgtatttgcgatgatctacggtataagtgggattggtatcgctaaattaaaacaagagtaacgtaggaagaaaatacttaaggaattactcgtccttttaattaaaaccagtgaaaaagagcggttagttttagaaaattttatatgaagcaatttttcgtatttgtatggtgaagctaaagctcgatattattaaaggaagatacatggataacacacaaaaatattaccgcattgctttattgttcaacgccaataaggtgtatgatcgagaggtggtggctggcattggacagtatattcaagcatcgcaatgcacatggaatatttttgtggaggatgattttgtttaccataaagaaaccattgaacgactgtctattgatggtattattgcagactttgacgatcctgaaaccgtttccttgttgaaaaatattgatgttcccactattgcggtaggggggtcttatcagaattttgctgattatccgcactttccttatgtcgctactgataattacgctttagtcgaaaccgctttttcccatttaaaacataaaggaattagtcaatttgccttctatggtttgccgactcaaggcactcggcattgggcaaatgagcggaaaaatgcttttgtagatctaatggaaaaatatgcttatcaattttctgtatatttaggtgataaaactgattcaggcagttggcaagtggcacaatctgaattatgccaatggctacaaacattgccggcacataccggcattattgcagtcacggatgcaagggcaaggcatttattacaagcctgcgaatatttgaaaatagccgttcctgagaaactttgtgtgattggtattgataacgaagaattgatccaatatttatctcgcatttctctatcgtctgttgctcaaggtaccaaacaaattggttatcaagcagcgaaaatgttgcatagcctgttaagtggacataaagtgagattacaaccaattttaattcctcccttaaaagtagaagaaagggcttctacggattaccgttctttgcgtgatccttttgtgattcaagcaatgcattatattcgccaacgagcctgtcatggtattaaaacagagcaagtattggatcatttaaaaatttcccgttctaacttggaacaacgtttcaaattggaattaaacaaaaccgttcatcaaattatccatgaagaaaaacttaaccgagccgtgtatttacttcgctttaccgatatttctatgccagaaattgctgaaatctgcggttatccttctttgcaatatttttatgcagtaatgaagaaagcctatgggataaccccaaaggcttttcgtcgataaattactaaagcactaatgatttagttactgattgagtaaaatcagggttgaaaatctaaaaaaaatgagaataattgaaaactgtttttattttattagtaagctgtatgaaaatcgtttatttaagttttggttttatttttctcgcattaggtattcttggcattattatgccgggattaccgggttttccatttttactcttgactgttttttgttttagtcgaagttcggagcgtgtgcataattggtttttgcaaacaaaaatataccaaaagcatgttttacctttcaaagaaaagaagggaatgtacaaaaaaacaaaatacaatatcttgatttttgcgactgttatgatggcaatggctttttactttacacccagtgcggtcggaaaagcgatcattcttatcgccttggtcattaaatattggtatttcttatttaaaatcaaaaatttaaaaacttaactggtattgtccaagtgtttttgtataatgccctaaataatttaaataagtaacaaaaatgcctttttatttctttcgtatttatctttttttattactaaaaagtgcggtactttttggtgtatttctgttatcggcttgtaatgaaaaacaagagacgattaagactgaaaattttcaacataaacggtctgagcaaattcggttacaagaaataacaaaacaacaattaacacgaggggtttatgctgatttggtaatagatcctttattgttgaaaaaggaagaacagacagagattttgcgtgatatttttgaagggttgacaggctacaatgcgcagggcaaagttattccggctgttgcagaacattggcaaacggaagacaacaaaaactggatttttgttttgcgtgaagatgccaagtggtctaacggtgttacggtgaaagcacaagattttgtgaatagttggcggaagttggctttatccgataatcctttgaagatttatctccgtttaatgaatattagtaatgcggaatttgtcttaaataaaatcttgcccatagataaattgggagtttttgcctcaaatgaacgtttattacatattcaacttgataaaccgacaccacaattaccggcaatgttgacccatgctgttttattacctaaatatcaatcgacagataatgaatttataacaaatggtgcttatcaaattgctgaacgacaagaaaaacaaattgctttagcaaaaaatccttattatcgagaatcggaaaatgtttattttgatcgagttatttatcgagaaatttcccaaaatcaatcggttaactctttagatctcgttctgaatgcaaaatcatcgcaggaaaacttaatttatttgccccaattatgtgtttatttttatgaatttaatttttctcacccccatttgaaaaaaagtgcggttcgtagggcattaatttcaatggcaaccattccacaaacttttttttcagcgaaaatgcaagcaattcattcttttttgcctcattctttgcgattaggacaagaagacatttgggagccgactattgtggaaaaattattcgcagaaagccaaattacagaaaaattgccgttaaaattcacgttaacttacgataaaacggaaatacaagaaaacattgcaagaaaatttattcaacattggtcgcaatcagatttaattcatgtaagagcaaatccggtttcaagagaagaattattgcaacaacgggcaattggtgattttgatgttattcgttcaggctggtgtgcggattataaggaaccgtcaagttttttgcttaattttcattctaagagtccggacaataaaacaggctatcaaaatattcaagtagatcaattactggaaaaagcgttgcaatccgttgaggaaaaagaacgaaatgctttttacatggaaataataaaaattttacaacaagatcaagtagtattgcctatttttcagccttttattcccatttggcaaaacaacattttgggtattgaacagaacaatgatacaggtgtgatatatagcaaagatctgtatagacagaagaaagcaggcgagtgagaataccttatttccgcataaataacctatttaacttttaaacatattaaggatttattgtggcattaattagtttaaccaatggctatctttcttttggtgatcagccgttattagattatgcagaattacatattgaggcgggtgaacgagtttgtttagtcggtcgtaatggagcaggaaaatcgacattaatgaaaattttggcaaaagaagtcattatggacgatggcaacttgcaatttgaacgagacttgattatttctcggctggaacaagatccgcccaaccatgcagaaggcaatgtatttgattatgtggcggaaggcatagggcatttagctgatctattaaaagattatcatcgtatttctctgttattagaaaaagaatacagcgaaacattgcttaaccaattagcacatattcaagctgaactggaacataccggcggttggcaatttgaaacaaaaattaaagaaactttagctaaattagatctaacaccggatactttgttggttgaactttccgggggtggttacgcaaagccgctcttgccagagcattggtttgtaatcctgatgttttattacttgatgagccgactaaccatttagatgttgaggcaattgaatggctcgaggaatttttgttgacgtttaacggtagcattatttttatttctcacgaccgctcttttatccaaaaaatggcgacacgtattgtggatttggatcgaggcaaattagtttcttatccggggaattatgatctttatttagttactaaagaagaaaatttacgggttgaggcgttgaaaaatgaactctttgacaaaaaactggcacaagaagaaatttggattagacagggaattaaagcacgtcgaaccagaaatgaagggcgggtaagagcattaaaagcattacgtgaggaacgtcggcaacggagagaagtactgggtaaagctaaattacaattagataattcaagtcgctcaggaaagatggtgtttgaattggaaaatgtcagttatgaagtggcaggaaagacattattaaaagatttcaccaccacgattttgcgtggagataaaattgctttggtcggtgcaaacgggtgcggtaaaacaacgtttatcaaattgttgttgggagaaattaaaccaacgtccggaacggttaggtgcggtacaaaattagaaattgcttattttgatcagtatcgtgcagatctcgatccggaaaaaacggttatggataatgtcgctgatggcaaacaagatattgaagtgaatggtattaaacgtcatgttttaggctatttgcaagatttcttatttccgcctaaacgagccatgacgcctgtaaaagcactttccggcggagagcgtaatcgcctgttgttagcaaaattattgcttaaacccaataatttattaattcttgatgaaccgacaaatgatttggacgtggaaacattggaattgttagaagaattattggcagattatcaaggtacgcttttaatcgtcagtcatgatcgtcaatttattgataatacagcaacagaatgctacatgtttgagggaaatggtgttctgaataaatatgtgggcggtttttttgatgcaaaacaacagcaagctaattattttgcttgtaaagcagaggaaaaagctaaacaggaaaaagttaaagaagaggaaaaaagcgtaaattcagtcgttgaaaaaacggaatacaaaactcgccaagtgaagttatcttataaagagcggttggaattagagcaattaccgcagttattagaagaattggaggaaaaaatcaccgcacttcaaatggaaattagtgatgtgaacttctttcagcaaccgcatgaatatacttcaacaaaattacagaccttagcagatatggagcaagatttagagagggcttttttgcgttgggaagaattggaagaaaaaaagaatttagccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttatgccaatgcggcagctttccaactcgccgaggtgtccagttccggtttaggacgagcttatgcgggtgaggcagcgattgctgataatgccgctgttgtggcaaccaacccagcgttaatgagtttgtttaaaacgaaacaattctcaatggggggggtatacgttcaatctagaattaatataaatggtgaggttaatgttaatgtagggaagggaattgtacaagttgcagatgaaaaagcagatcagaaaaaggttgtacccggtgcattagttcccaatttgtattttgtggcacctattaatgacaaatttgctatcggtgcgggtatgaatgtcaactttggattacaaagcaaatataaaaaggattatgatgccggtgtttttggcgggactactgagctgaattccattaatttaaatttaagcggttcatatcgtgtcagcaaaggattaagcgttggtgcggggttaaatgcggtttatgctaaagcaaaaattgagcgtcatgcgggggttctagataaggcaattgatactattgccgattctaagggaatggctgggagtatcaatattccttcattaacattgttagtcccaattttctcccagttaaaagatagagtgaatacggatactctcttaacacaattacaagataataatgcatggggattcggttggaatatcggtgcggtttatgaatttaatcaaggtaaccgtatcggtattgcctaccattctaaagtagatattaattttaaagatgatgatgcgttgagttatcaatttgaagcaggaaaaattagtcctgttaaagagaaaggtgggttaacgctacatttgccggattatttcgaaatttccggtttccaccaattaacggaaaaattcgccatgcactacagctataaatatactaaatggagccgtttacaaagtttacatgccacttatgataacggtaaggtcgctttccataaagatgaaaaatttcatgacagttcacgtgtagctctaggggcgacttataatgtgaatgataaattaaccctgcgtgcaggtattgcttatgatgagtctgccgaccatccgagtgcttcaatccccgataccgaccgcacttggtatagcttgggtgcaacctataactttacgcctaatctttctgttgatgtaggttttgctcatttacgtggtaaaaaacagcaatttaaggaaaagcataagattggaagtacaggtattgagttcggcagtatagatgcaaactataaatcaacagcacgtgccaatttgtacggtttaaatcttagctaccgtttctaacggctatccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttattcttccaaaatctctgcaaaaatctgaatccctttgactcctagtgcggtggctagaccaacgaaatttgcaccagtggttttcattcgttcaaagccggctttgtcattaacaccgcccacaccaataatttgtacgtcttttaattttggttctttatccagcatttgacgcagagtatagacattgcctaatgataatgcgtgaattgctgttcctgccagtcctccaatacctgttcctgtttcagaatttaatatggatttcccctcttgcatcactaatgaagagccaagcgtattagtagaagtaataaaggaaatcggtagtgttttattttctgttagcgattttaatagtccattaattaattcatcatattggttttgataggtaaatggtggaattttaatgccaatcggtaaggcctcttctcctagacttaacttggctaaagtggtttgtaacgcatttaaataaggtaataattcttctgctgcataggcaggcgaaacttttccagccatattcgggcaagaaatattgatttccattgctaagggcatcttcacttctgtttgcagagccacgatttgctcatagcattctcccacttcttcaggtgaaccaaacacggaaataatgaaaggcttgttggaaatagtctttaattcatcggagatagtacgaacaaagcgaatggtagtcgctaaattattgggactaagtccaattgtatttaggctggtagtttgttgtggagtagcattgggggtattaacactggctgttttttgtgatgttgaatcaaataatacatattggttttttgtccagtcatgtggatagggaactagcatagacgtgcgagttgtaaccgcacctgtatattgacaagcataaagttcacgtaaattttctaattcggaacaccaagggcaaggggtatttaatagggcagggtgaatgttaagttttttcattttggttttctccataattagatcatagttaataaaaaaggacgctataaatagcgtcccggtaagttaagattaattcttttcagatgtaacaaattcaatagaatggtaactaaatcacaagatttgatgttttttaatgaaaatttatggatatatattaacatgttgctgatgcagaaaaaacattaccatagaaagagtgttgaacgtggttgagaaagtcaatcttttatttatacaagatttctaaaccacgttattaaactggggcggtaatataacttatttcagcaaaaatgagaagctaatttagctatattttatctaaaaattttagggtattagaattcagtcaaaattttatcctttgaaagagggtaatatgttaaacatcgatagaaaatggaaaagtgcggtaacaataccaaatagaataaccagtagaatagtgacgtttccgcctgcaaccataaacctttgtttaccattaggtaattgacgtgatttgtaagccaataatgcagggataatacaagcccaaattgttgccaccgcacctgcataaccgatagctttcaaaaaacctaatgggaaagcgactgataatattaatggaggaaggaaagttactgcccaagattttgttctccctattttgttgtcatcaaatttaaataagtcagccaagaagtcaaatacacctaaacctacaccaatgaaagaggatagaattgcagcaatggaaaaagcattaatagcttgtttaactgatgcagattcaattacatttcccaaagctttgagtaacacatctaaattgccatcacttgcaatcactggtgcaaattgatttcgtggcagattaccaaaaatggaaatgacccatagtaaatagagtgcaagagcaatggtggttccgcctaaaatagctaatttggctttatgttcatttttatagtatgcacgcattgttgcaacagagtggtgataaccgaatgatgttaatgcaacgggtaataagcccatagtatatattacataactattatctgagtcggtatttgtattaaataaaatggctaagtcaatatttttagttaagccaaatacactaagcataaaggaggttgtcataaaaataattaatataacggaaatgcgatcgacaatgcgagtagaatgccaaacaaagaaagagaatatcaaaacgaagataattgaccaaactcgagagtcaatgttgaacatttcatttgttaatccacttaggatgccacctgatgctgtagtataagcgtacagtaaaatacctccaacaaaataaacggataaattgttgatgatgttgacagtattacctaataggcttttggttactgtattaaaagaagctcgtaaatcaaaatgtttataagcctcaagtaataaccaaccggataacgtcatgcaagtcatcgtaaatccaatggtgaggacagaccaaatagtccaagctcccgcaccagatgtaggtaagcctaacattccggcaccgacacagacactcgcaataatgcaagcgccaccgaaaatagaaggtgatttttgcataatatatctccttttgaaaactataaaaaaacaccgcactttttgttaaaagtgcggtgccaaatttaaatctcttttaatcgagcggtgaaatgacgcagtactttaggttcataagtaaaatctaaccctttgatattttttgcattctctttcactcgtttgaatgcttcaataatgaagtccatatgtgtttgagtgtaggtcgcacgaggaatagttaaacgtaacaattcagccgggcaaggtaattgttgacctgttttcggatctcgtcctaataggagagaaccgatttctacggatcgaatacctgctactttatataattcacaagcaagagcctgagcagggaattgttctgctgggatatgtggtaataatttgcctgcatccacaaaggcggcatgtccaccgggttgttgacaaacaacaccgatcttttctaaaccttgtacaaggtattcaatttggctaatacgataagctaaccaatcttgacgcataccatcacgtaaacctacagctaggcgttccattgcaccaccttctagaccaccataggtagggaaaccttcttgtacaacacaaagtgtacgacactcgttgtaaacatcttccattgaattatctttgaagcagagtagtcctccaataggtaccattgcatctttttttgcagacatagccaaggcatctgcatatttatagctttcgtaagtaatttgttcaatagtccaatctttgtattctgcttcacgttgttgaataaagtaggcattttcagcgaagcgagccgaatccataatcacaggaatatcatatttacgtgcaatttggtacatggctttcatattggcaagagataccggttgtccaccggcagaattacaggtaatagtacatacaatgtaaggaacattatttgctccaacttctaaaataccttgttccagtttttctaaatcaaaattacctttgaaatcatgatctacatctgtgtcaaaagcttcttttatatagacattacgtacagttgcaccatttaattggctatgaccttgagtagtgtcaaaaaaatagttagagaaaacaaccattttatttcgatccaaccctttttcttgctcacgttttttgatcaagacaggaatataaatttgttctgcaccacgaccttgatgggttggaattgtgtattcataaccaaagatttctttcactgcattggcaagagcatagtaactgcgacttccgctataagcttcatcacctcttagcatggcagcttgcatatcttgagtaacggcacctgtaccactatcagttaatagatcaataaaaatatcttcactgtctaataaaaatagattcatacctgcttttaagatagcttcatcacgataggcacgagttgtacgtttgacaggttcaataacacgaatacggaacggttctggtaaatgtttgaaattttccatgattaaatcctcaaataattgattaaaaaatgtatattacaaaaatattattaggattgaggagttatgggaaaatacagggatagctttggatctacaagtatccaaacttgatttggtgataaaacatttaccatagcttatccctttttagaaatgaaatgtaatttatctcagacgaggaagatagtaacttagcaattgcactttgtcatatagaatgttttaaatttgtgaactaagtcaaaaattttgataaaaaataagactctacttatagagtcttatttttatgaaagtgcggtttgtttccgcaaatttttattgtgtcgcttgaattgcagttaatgcaatagtatacacaatatcatcaaccaatgctccacgagataggtcattgaccggcttacgcataccttgtaacatcggaccaatagagattaaatctgctgagcgttgtactgctttataggttgtatttccggtgttgagatctgggaagacaaatactgtcgctttaccggcaaccggagaatttggtgctttagattttgctacatcttccattactgccgcatcatattgtaatgggccatctattaataaatccgggcgtttttcttgggcaatacgagttgcttcttttactttctcaacatcagcaccggaacctgacgtgcctgttgagtaagagatcatcgccacttttggatcaataccgaatgcttttgcggaatcagcagattgaattgcaatctctgccaattgttcggcagttggatcaggattaactgcacagtcaccataaacaagcacttgatcaggtaataacataaagaagattgaagaaacaattgagttaccaggtgctgttttaatgatttgcatcggtggacgaatagtattcgctgttgtatgtatcgcacctgaaacaagtccatcgacttcgttagcctcaagcatcatagtgcctaatacgacggtatcttctaattgctctcgtgcagacgtttcagtcatacctttggctttacgtaattctactaaacggtctacataattttcacgtacagagacaggatcaattattgtaataccttttcctaatacaacgccttgagcatcagcaacacgtttaacatcatcaggatttgctaataagatacattctgcaataccacgttctgcacaaagactagcagctttaactgtacgaggttcatctccctcaggtaatactattcgttttttggctgcacgagctaactcagttaattgaaaacggaatgcaggaggagataaacgacgaggacgagttgaggcggcaactaaattttcaataaatgaagatttaaattgttggcttgtgtattgtttaatgttttcgatgcgttctttatcatcaacaggtacttcaaggttgaagctttgtagagccaatgcactttgccatgtattaccttcaattcgaaaaataggtaagccggtattttcaaatactggttggcatagttttttaatttgattgtcaattttgtaaccacctgtgagtaaaataccacctagctcgatcccgttagtcgcagcaagtgcggaggcggttaggacatcaggacgatcagcggaggtaactaacagactacctgttttgaaatgctcaaccatattttgtaatgaacgagcacagaaagtaatactacgaatacgacgagttttaatatcaccctcatgtagaatagaagcacctaaatgattgaccaaatcaatagcacgagttgcaataagctccgcattccacggaacgcaagctaatactttaatagggcttttttcaaatagcttgtaaacctcattaaggttattttgtttatgttggtaagcatcaaaaatttcacttaggtctggacgagtacgtccggattcatcaattggggcattaaatttattaattatgacaccaagtaagtttggattattttttccgccaaattgggaggccgccgcttcaatgcgttcttttaactctgccggcgtttctgttgcaggtgctgcaactaatacgatttcagcatctaacgcctttgcaatttcgtagttgatactgtttgcatagccatgcttgcgagttggaactaagccttcaacaataatcaattcattatttttagctagttgttgatgattttcaacaatcttttccagtaacacatcggattgattttgaccgattagattttcagccacacttagcataaacggttcggctgtttcaagtgttgtactggtacgcacaattgaagtagtgcggtctaatttatcttcatcggtacttggttgcgaaattggcttcatgaaaccgatttttgcccctttttgctcaagagcgtggattaaacctaaacttacactggttaaaccaacaccggtgctaataggaataaggataattgtacgagacataaaaaaaccttaaataatgttgttaaaaaagaaactgccgaatttatcggcagcctgtagattacaattagaaacttaaacgagcagtatcttgtgcaattacaagttcttcgtttgttggaataacgattgcgattggcgtattatccgctgtaataacaccttcattaccaaaacgagctgctgagtttttctcatcgtcaattttataaccaaatagttttaaatgatttaaagtaatttgacgaaccaaggcggcgttttcaccaataccgccggtaaagacaatcgcatctaagttttcgccaataatagccatgtatgaaccgatatattttgctaaacgatagcagaatacatctaatgcacgttttgcagcactttctttttcatagttatcttcagaataacggcaatcactcgttacttctgttaaacctaacaaacctgattttttaactaaagtttcctcgatctgtgccactgacatgcctaacgtattgtgcatgtaaaaaatgattgctggatcaagatcaccggaacgagtacccatcaccaagccttccagtggagtaaagcccatggaagtatcaatacatttaccttggcgaattgcagcaacagaggcaccgttgcctagatgacaggtaattacgtttattttatcttcagcaatatttaaacgtttggcagcttcacgactcacgaaatagtggctggttccatgcataccataacggcgaacgccatgttctttgtataaagaatatggcagagcgtataagaaagcttcttctggcattgtttgatggaaggctgtatcaaatacggctacgttgttatcttttaaatgaggaaatgctttaaatgcttcttcgataccgatcaaatgtgcagggttatgaagatgagcaaattcagcagcatctttaataccttggataacttcatcggtaataacaacagatttggtatatttttcacctccatgaacaacacggtgtccaatggctgcgattgaatttttaagatcttcagttaagatagttgaaacgataaagtttaatgcttcactatgtgctgcaccggcacctaaatctgcattacctttctcaccgttaagtttccacttaattcgggcatccggtaggtagaacgcctcggccaaacctgataatttttcagcaccagaaactggatcaagaatagcaaattttaaagatgaactaccgcagttaagaattaggactaatttttgagacatacgagacctattttgaaagttaagttaaaaaataaattcatttactcaacaatattccaagtaaatgaactgacatgaaagtctttgccctgcatagaatacacttttcagataataaaataaattggtaaaatcaaaaaatacgacttttatcaaaaaatgtatcaaactcatcgtttaattttcttgataaaaataatagatttttttataaataattctaaacgaatatgtatcaaacactaaaattaggtcaacgttatttggaaacttggccttcaatacctaaactgagtattatttttcctgaaaatcgagttattaaggtaacattatttgcacaaaaatttatgccgtttttagcagtattttcattagtttggcaacaagtttatataaaacatgatttggttgctttagctattgcagttttaaccgctttgtttgcgttgagcttgccattacaaggtctatattggctaggtaaacgttcaaagttgcctttacctccacaaacaaaggtatggtttgataagatagttgaggtgttacagcaaaaaaatactaatcttgtttctattgagcaaccaacgtatcaggatttggcagagttattgcgtaaagctgaacagaaattagatactgagttttggcagagtatttgagcgaagtttatcgctaaacagcaagtgatatatctaatggggtgaatatagtaaaattttccccgcacttgggtatcaagtagcttattttttcactagataaggaaagaaaatgctttgtgctatttacaagactaaaagaaaagaagggatgtatctttatattgaaaaacgggggtattttgattccgttccatcttccttacttgagtcattcggcaagccaatttttgtgatgttatttaatttagcaggacaaaaatcattgattaatgctaacaatgaagatgtgcaacaacaaattaaacaaaatggattttatttgcagatgtcaaaacagcaagaaaatttacttgaacaagaaagacagtatcttaagcacaataaatgacatgatcaatgatatgattttttaaaatttttaccgcactttgacacttttgaaaaaataaaggcgatcatagatcgccttaaatgtataaattatgctacacagactgtttcggttggtcaaataccgtcactttcggtgcggcttctgtgtatttttccacttgaacaatacatgtattcggggaattaccttgtgctaattttgaagtaccttcatcacgtgtcagtacgttggcacaaccatttttacacaaaggttgttctgattgacctaaatcagccggatcataccaagccccctcatgtaatgcgaccgtacctttaataattccttcagtaactaccgcacctgccaatacttgtcctcttttgttgaaaatacgaacaatatcaccatccatgatgccacgagccattgcatcttctttatgaattaacacaggttcacgatcgtttactgcatattttttccgtaacgatgtgtgagccaattgactgtgtaagcgatagtaaggatgtggtgtaactaatgctaaaggggcttccgtcgttgtattacctgcaaattcttcaggaacaaaccaatatggatgacctttacaatcatcataattcatttttgcgacaacatcagagtaaatttcaatttttcctgatggtgtaccaagtggattcagtaaaggatcattgcggaatgcttcgtaacgtacccatttttttgatttttcagttggtttaaagttaacaggtttattttcttgccagaatttttcaaatttcggcataagtacacgatttttacgtgctgcattaaatgccacgttgtaaaaatcttgcaaccattccatttccgtttttccttcagtaaatttgtcttctactcctgcacgtttggctaattctgcaaaaatatcatagtcatttttcgcttcaaattgtggagggacaacttgtttcattggaaaaatattcatcatggcataatcaccggacatagttaagtcgttacgttcatagctcgttgtggctggtaatacaatatccgccatgcgagcagtcggtgtccagttaacttcattgacaataacagtttcaggtttttgccatgctttcactaatgtatttgtatcttggtgatgaacgaaaggattaccacccgcccaataaattaacttaatgtcaggataggtcactttagagccattataatcaattgtttttccgggattcagcaatacatcagcaatacgtgctaatgggaaagagaattttgatgtatcatcaagccatgttttttctccggcttgtactgatggattagctgtaattgaaccaataataccaccgactgcagaaggtgcaccaccattagaataatgataactgaaaccaaatccgcctccaggtaacccaatttgtcccagcatcgccgctaaagtaactaatgtccagtgagtttgttcaccatggcgttgacgttgcataccccaaccgcccattaacatagtacgttttgacgaaaaatcagctgctaactgtttgatgatatctgcaggtaacccacaaattttgcttgcccaatttgcgtctttcggttgaccgtcagtttttcctaataaatattgttcaaatttatcatagccagtagtgtattttttcaagaatgccttatcatgtttatctgtagtaaccaacgtatgtgcaatccccaacattaaaggaacatcggtgcctgtatgcacaggtaaccattctgcatttaagaattcacagctttcacttctaaccggatcgatacaaataatacgtttaccgctttctttcaattttttgaaatattcaataccttgttgatcggtagaagtccatgcaattcgcaaagtcgtaagaggattagccgcccataacacaacaatatctgaactttctaaaacggtttcccagctggtttgttgttcataaacttcaattgtacctaatacatgaggcataattacttgtgccgcacctgttgaatagtcccctttgactccgacaaatccaccggtaacattcatgtaacgctgtaacaaagtacggctagcatgtaatgcacctgagctataccaaccataagaaccggcaaaaataccgcctgcaccataagcatcacgaacacgtttcatttcacctgcaactaaatcaaaggctttatcccaagaaacacgaacccattcatcacgtccacgcaaactggtatctttattaccctccaaaaatcctttacgaaccattggatattttacccttgtttcactataaagttggtcagctactacgctttgtaattcattttcgactgaaattggcattgcagatcctgatttaactaccttgccattttctacaactacacctaaagccccccaatgagcagctgttacaacggtatgttgttcagccgccacagctttcgaagctaatgttccgacaacaccgccacttagagatacgccagccacgcctaatgatgaattttttaaaaaatcacggcgacttgtattaactttattttgtgttttcattttaaacctcgttatttactaggctcacaatgaactggtgaaagaaaagacatcgaaacggttagaaaacacaccgcactttctccaacacattgtgaaagttttattttcgacacctttctaaagggagtggcacaaccatttctagttataccatgtgcaacatttgacaatgttacaggcttgcaaccttattttgcaacttaggtcaacaagctcggagtcgtcagttttttcaaaaatttcagcgtttcctttaagcgtagcttaatggcttttttcgccaaaatctttggcattgcgttgtaaatagattgttacagatcgtacgtcatctgctgtcattgatgtacgatctttcatcgaatttacaacaccaatccattgatttgcagtgtaatgatctgccccaattggtgcatgacaaccactacaatgagtttgatttaaattatttccaaactgatttaatgcctctaaattagacgttagtgcattttttgccacgtttatttcaaacgtaacctctttccactcagaatctgtgactttgtcatgaacagtttgcaacacgttcacatttttctcaattccatcacctaaagccaacataatgcgttgccctaattgtgcatagactattgtttccgcccctacttgttgccagccgtgaattgtgccgataacattgtcatcttgcaatttccaatcattcacttctgcaaacggcattaaccgcacttcatcgccttgtgccagctgtgccggactcattgccaaactatataatattttatcggtttgcttaaattctcctgcatgtttagttaattcaccatatgcggctgtatcatcaacctctatttcaggcataaaatgagcaatacctttatggcaatcaatacaagtttgatttgtttcgatgccggttttgtgcattttttgtgctgtcggtgtttgcgaagacatttccattgcttcgaaactatgacaactgcgacaagtggcagaatctgattcttttaaatcttgccaaacggacttcgccatttctaaacgatgcttttcaaatgcttcttcatcaggcaatttatcagtaacataagtatgccaaagatctttcactgcaaagacttttgttttcacataatggaaaacgttatcttgcgggatatggcaatccgcacattcggcacgaatcccttttcggttagagaaatgtatagaggcttcccattctgcttgaggttgttgcattgaatggcaagaaacgcaaaattcagtggtgctggttgctttcattgcatactgtactcccgctaaaataatcacccctaataacacaccaacgattccactaaacagccattttttatttgattttgccattcgcttttcccccaaaaataaaattcaataaatcaattacaacaaaaaaatcatactcttatattgtaacgatatgatgttggtaattcactaggcacacacgaaaaataacggctatttgcaccgctcttgacgtagatcaatatttaaatttaagagtgaatatgtgaaataaaatgcgtaattttatgtggcatttttagtattttctcccataaattgaaaggattgatatggtacaattttgttttttatcttatgcagaggaaaaggataggttcttttttgtgccactattaaagttaaaggagaaaagcaatcttgttgttttttttcactcaaattgacttgatcgagtatttcaaaatttaataattttatccaatcaaggatacgccaagtgaaatattgtctaaagggaagtgcggtttgatttttatgatttaaattttgtttgaaaatcaatgggctataagggttaaataaggaaataaagagataaccgtcattttctaaaactctggctatttcacctaataattgatggggatgttgcgtgaagtttaatgtattggctaatacgcaagcgtgaatagattgttgtacaaaaggaagttgtaatggatcagcttgtatcagactaatttcttctattacgttttgattagccggaaaaagtgcggtaggatttttcgtcatttccggcatgaggattattttgtggcgtaaaggtaaattgagttctaattcagcacttaatccgccaatcatgagccactgatcgcctaagactttttgaaaccaatctgcaaaaaattcgttgattaggctacaatacattgttcctttttgtatatgttgccaactcatcggcaatcgataattttttactgattttatgttgaagttcatattttctaacttgataccctttggaggagcttgatgttaattcctattcctgcacttaatgataactatatttgggtgtataaacgagagaatttatctgtaattgtgatcgatataccggaaatagctgcattatctcaatttatacaggcacaaaatttagtgattggagctttgctgatcacacataatcatagagatcatattggtgctttggctgaatttaagcagttttatcctcatgttcatatttatggtccggcagaatgtgccgatcaaggggtgacacaagttattgatgcaggaaggttaattattgatgaatatcatatagatgtattaccgactggcgggcatacggcacagcatcttagttttttggtagatggtcatttattctgtggagatactttattttctgccggttgcgggcgtgtttttacgggagactattcgcaaatgtttacttctttacagttactcaaatccttgccggataaaacaatagtttgcccagctcatgaatatacgttaggcaatttagcgtttgctttaactacaggcaaaaataaaagtgcggttcaaaagcaacttgaaaaagtaaaaaaactaagagcagaaaataatcccagtttgccgacaacattagcattagaaaaacaaattaacccatttttgcaagtcgagggtcttgaggaatttattgagttgcgtaaagcaaaagatgttttttaatttaaattagacattctattgtattaataggtaatcgaatttgctcaatgtgagacaatttattagaatagcgacgttttttacatgaatttcccaacaataaattatttatgaccattcttgttctcggtattaatcataaaactgcgtctgttgcactacgagagaaagttgctttttctgaagaaaagcacttgttggcattgaagcaaattaaacaaactcagctggcagaatgtgcggtgattttatcaacttgcaatcgaacggaagtgtatttacataataaaaatgttggacctcaaaatgatgaagtctggttagatagttgtgttcaatggtttgcagatattcatcaagtagatttagaagaactgaaaagttgtttatatagtcagcagaatttacaagcatctcgtcatttaatgcgggttgcttccggtttagattctttgattcttggtgaaccacaaattttaggtcaagtaaaacaggcctatcaaatgagtgaagagtattattcactgcattctgatattggcatgatgagtactgagttatctcgcttatttcaaaaaacttttgctacggcaaaacgagttcgtactgaaactcatattggagaaagtgcggtatcggttgcttatgcagcctgtagtttagctcgtcaaatttttgatagcttacgcaatttgaatattttgcttgtgggtgccggagaaaccattgaattagtcagccgtcatttattgcgtcatggagtgaacggcttagctattgctaaccgtacgttatctcgtgcggaaaaattggtggaaaaactggaaacaacacaaaagatagatatttttagtttagacagactttcggaagggttaaagagagcagatattgttattacctctaccggcagtcctcatgttttaatctcccgaaacttgattgaacaggcacagcaaatgcgtcattacaaaccaatgctgattgttgatattgcggttcctcgtgatgtggaggaaagtgcgggggaaattgaatctgtatatcattacactgtagatgatctacataatattattcaatataacatcaaccaacgtgaacaagcttctcaacaagctgaacatattattcagcaagaaagtgcagatttctttgaatggcttaaagtacatcaattttctaatttgattcgcaattatcgagaaagtgcggagataattagacaagatttactcgaaaaagccttgcaggctctgcaaaatggtgagaatacagagcaagttttacaagagttgagtcacaaactgactaagaagctgatccatcaacctactcaagctatgcaaacgatggtaaaagccggtaatacagaaggtttacaggctttttctcatgcagttaagtcctaggaaagtacaatttatttaagtttatccagttttgccaataaaataggtgctggttgttgttgaattttatacatacgccaaagcagtaaaatagcagcgattgttaaactcactacaaaagatacccaaaagccggcagcaccgatacttggaataatccagtcagttcttgataaggaaaatcctaacggcatgccaatgccccaataacaaaaaagggtaatgtataaaatagcttgtgtatctttgtatccccgtaatgcaccactggaaactacttgagctgtatccgaaaattgataaagtgcgacgagcatcagcagactacttgatatagcaatcacttctttatcatttacaaaaattgatgctatttcatagcggaagaaaaagatgatggatgccgtcaggaaagcaatagataaacctacagtaagagcagagaaagatatctgcttggcattatctattttgccttcgcctagacgttgaccaacaagaatagtagtagccatacctaaagacataggtaacataaatgcaaaggaactggtatttagtgcaatttgatggcttgctacaacttgagtaccgagaggtgataataatagtgaggtaagtgcaaataatgccacttcacaacataaagaaaccgcaataggcaatcctaaacgaaataattttgccaaagttttcgtatcaggtttttcaaataaatgttcaaaaaccttgagatcacgttgatttctagcatgcttactatagacgatcatcattaagcacattatccagttgacaatagctgttgcaatgccacaaccaaccgctccaaacgccggaatacccaatttgccgtaaataaaaatatagtttagagggatattgcatagtaagcccaaaaacgtaatgaccatagccggttttgttttggcaatgccgtcatttaagcaacggaagttaattaataataaataaccaggtaatccccataacattgcacgcaaataaccgatggtaatattggcaagtttttcttccattttcatatactgaatgacaaaatcgctattgtagattaataagccaagaggaatacagctaataaaaacaatccataagccttggcgtatttgatgagcaatatgatctcgttgtccggaaccatttaaataagagattgttggaggcaaggcaagtaataagccatgtccaaataatactaggggtaaccaaatagatgccccaactgcaacggcagccatatctgctgcactaacacgtccagccattattgtatctactaaccccatggaattttgtgctacttgtgcaagtaaaataggggtagcgatggcaattaattttttagcttctgtgtgatattgttgaaaacgagttaatttcataaaaatccgattttgctataatattggaaatatttatttagagagaactttatatgtttacaggaattgtccaaggaacagcacaaattcagtctattattgagaaagctaattttagaacacaggtaattaaaatgccacaggatttattagcaaatttagaaattggtgcatctattgcaaataatggtgtttgtttaacggttacagaaattaagggtgatttgattagcttcgacttaatggcggaaacattacgtattacaaatttaggtaatttagcggtaggcgattttgttaatgttgaacgtgcaatgaaaatgggggatgaaattggcgggcatattttatccggtcatgtttattgcactgcaacaatccaaaatcgtattcaagcagagaataatttgcaaatttggtttgaaatgcctacagctgaattaatgaaatatgtgttaactaaaggatttattgcaattgatggaattagtttaaccgttggcgaagtcaaagggcagtgcttttgtgtgaatttaattcctgaaacaattaaccgcactttgattgcaaaatatgatataggtgatttagtcaatattgaaatagattctcaaacacaggcggttgtggacacagtagaacgatacttggcaaacagataaattcattttgcctaaaatctaaaattgtgggagtgtactctcacaattttatctatttatagcgtttttttgtgctttgctcatctaaattatgcaatcgtgctaatttttctttaagttgaatttccagtccacgatctgtaggaaaataaaatttcgtatcttttaattcttctggaaaataattttctcctgccgcataggcattaggttcatcatgagcataacgatattctgctccatatcccaactctttcattaaatgagttggtgcattacgcaaatgtaccggtacatcataatccggcatttcttttgcgagtttttttgcttgtttaaaggcaacatatacagcgttacttttaggtgcaacagctaaatatacaatcgcttgtgcgatagcacgttctccttcagctgcaccaactcgagtaaaacaatcccatgctgcaagtgctacttgcattgctctcggatcggcattgcctacgtcttcggaggcaatagctaataaacgcctggcaacatagagaggatcacctccggcagtaataattctagcataccaatataaagcagcatcgggagcggagccacgaatagatttatgtagagcggaaattagatcataaaatcgatccccttgcttgtcgaagcgagcctgtcgttcccctaatacttcagttaggagacgatgattaatcaatttccctttttctgtttcatctgccatatcaaccatgagttctaaacaatttagtgctaaacgggcatccccattgacatattcagctaaggtttcaagaacattttcagcgaaaatcaaccgctcttttcccaatccttgctctgcatcttggatagcattttgtaacactgtcacaatattagatgtagttaaaggtttcaaaatataaactttgacacgagagagtaacgcattatttaattcaaatgatggattttctgtggttgcacctataaaaatgatagtgccgttttcaatatgaggcaaaaaagcatcttgttgggttttattaaaacggtgaacttcatcaacaaataaaatagtttgttgacccattaaacgattttgttttgcccgttcaacactttcccgaatctctttcactccggcggtaactgcagaaatacgctcaacttgagcatgaatttgttgtgcaataatctctgccagcgttgtttttcctgtaccaggcgggccccaaaaaatcatagaatgaatatgtccgttttcaatggctttatatagtggctttccagctccgattaaatgttcttggccacaatattgcttcagtgtttgcggtctcatttttgcggctaagggttgaaatgccgagtgagagaaatcaagtgaaaaagtggacatataaaactccattaaatgattaaaagtggacgtttattacgtccaatcatttcaattttaattaattattttttacgttgatcgtcaaattcaacgcccttaggcaaggtaaatgtgaatattgcatcatttaaggctggattggtaatcttacgcagaatatacaagttactttgcccatcgttctctattgtactaaaattttttaatacaccatctttttcaattcgaatattaaattgcttgatggtacttttcttagatttgggtttaataataaacgtatcggatttttgctcaacaatatattgttgccaatgacttggattattacttgttagcaaaacaaagggggtatcgcttaaggtatcttcaacccaatttgctgttacttgctcaacaaaaggatcgtagaaccataatgtttttccatctgcaataatttgactttcttgaggtgtttcattgtccatacgaaataaattaggacgtttgagttgtatttttccactaccttgctgtattttttttccctgtgcatcagtcacttgttgtgtatagtcagcacttaacacatcaattttatttaaacgattttgtaactcattaaccgcatttgcccaagttacattactgatacctactaataaaagtgcggttaaatttagatattttttcattatttgtccttttcaattgagaatgaattgattcgatataatcaaaaggctgaaatgttgtataacatatcataaaagataagtataaaccctaaaaaataaataatattccgttcagtttatgatactgtgatctagtgcaaagaaaaaattttttcgctagctataatacaacttggtagtttaacagtttatttgaggagtatttcttatgcaaaattgggcacctgaagtatggcaaagtgcattaattggtttatgtattggagtttttatcggttacttattattgcgtttcactaaaggaacggtcaaaaaacagataaaaacagaggctgagttggagcaagtgaaaattcaacttaacaatcagaaacgacaattagagcaacattttgctgaaagtgcagagttgttaaaaaatattgcacaggattatcaaaaactttatttacatttagctaattcatctacaacactattgcctgaattggcacagaaagaattattttcaccgcatttattagccacggaatctatttcgtcacaacaagataaatcaaaagataatcagcctagagattattctgagggttcatcaggtattcttaaagttgaaaaataactatttctaaataggcacattgaggtgcctattttgctgtttttctttaatctctttgcatttctgaaacttttttgtattttttctgtcttaaattagcgatatatatgatttagatggagaaaaaagtgaaaaaatctagctttgttttaaccggtattgctttagggttaagtgttctaacaacatcaattaatgttcaagcaagtttgcctatggcagttgatggacaatctcttccaagcttagcaccaatgttacaaaaagttttacccgcagtagtttctattgcggtagaagggaaacaaaaaaataatttttctttcaataatgaaattcctgaagagtttcgccgtttttttggtgacagctttggttttgaaggatttagcagtcgtgcaccgcggagttttcgtggtattggatctggagtgattattgatgcagaaaaaggttatgtattgacaaataatcacgtgattgatcaggctgataaaatcacggtcaaattagaagatgggcgtgaattcaaggcaaaggttcttggcaaggatgatatgtcggatattgcacttattcaattagaaaatcctaaaaatctgaccgcagttaagatcgctgattctgataaattaagagtcggggattttacagttgctatcggtaatccattcggtttggggcaaaccgcaacatcgggaattgtttcggcattagggcgttcaacaggatttgatagcggagcttatgagaactatattcaaactgatgctgccgtaaatagaggtaattccggaggaccattagtaaatttaaatggtgagcttatagggattaatactgctattatttctccaagtggcggaaatgcgggaattgcatttgcgattccaagtaatatggcaatcagtttagttaagcaaattattgaatttggcgaagttcgtcgaggattactcggtattaaaggaggtgaattgaatgccaacttagcaaaagaattcaatattgatgtacaacaaggtgcgtttgtgagtgaagtattgccaaattcagcggcagaaaaagccggacttcaagcgggtgatgtgatcacggcaattgatggacaaaaactggcaagttttgcggagttgcgtgcaaaaattgcaacaagtggtgccggtaaagaaattaaattgacctatttacgtgacggtaaatcgaaaactgcgaaagtgaaattgcaatctgatgatggagatacaatttctgcagttggcaacatttctatattagaaggtgcggaattaagtaattataatcaaaaaggcacaaaaggcgttgaaattaaagaagttaaatcaagatctcttgctgctcaatatggtttagaaaaaggcgatattattattggagtgaaccgccataaagtagaaaatttatctgatttacgtaaaattttaggcaaaaaaccttcagctattgccttgaacattttacgagatgacagtcgtttttatttattaatccaataattttactgaacctataattcttattaagacaaaacgaaatccgcactttaaagattgaccgatcaaagtgcggattttttgtgtttaaagatgatgttcttgtctaatttttttgagtaacgcatcgcagcatttatccagtaattgataagtctgctgaaaattgccggtataccaagggtccggaatatgatcacaagctaaatcttcacatatcgtggttatttgaaaaagtttagatggtgctttcgtaaagaatttttccaaatcatgtagattgttgttatccattgcgattaaataatcaaattgttgccaatcactattgcgaatttttcggctggtaaaccctctgttatcaatagcatatttggtaagaatctttgccgtttcttggtgcatattttctccatcatgccaaccggaagttccggcactatctgtaaaaatttgattatctaaatgagctaatcgaattttttcacgcataatatattctgccattggggagcgacagatattacctaaacagacaaataaaattttaatttgtggtttcatgttaagcctttgccttatgatgaataaaagtgcggttgtaattgtacatgttttgtgccaatttagataagtttttattagcaataatctatggtaatattcgcttcccctttattttaaaagtgactaatcatgtctttaccaaaatatgttgaacaactgttaaaagagaaaagtaatgttcgggtattctcgtttaaatatgatgggaaatcttattggctaaaacaaaccgaaaaactttcttttatttggcggttcttgaaatccaatccagcggaaatgttaaaaagtgaaattattcgcttacaagaacttaataaaaaatcagcacctgtacctaagttagttttatttggtgataacttttttgtgactgaagatgtgggaagtagtgcaaatacttgggttgaaaatgaggatttatctattgaattaagaaataaggttttgtttgattgtgctcaagcattggcaagcttacataaacaaaatattactcatggtcgcccagccttaagagacatgatttggtgtgaagaaaaagttatttttgttgattttgaatgtacctcgtcaagtaataacatagattggcaaaaaattcgtgatggattagtttttattcatagcttaggacgttcttcaactgtttcggatgagcaaatagcattgactgttactcattatcgtcagtattgtgatgctgatatttggcagaaaactgctgattttatctataaatatcgttgggcatattatgttcttcgtattttcaaacctgttgcaagaatggatttaattgctatttatcgtttatttgaagctattttaaaaaatcaggaaacattatgataaaaaaaagtgattgtatggagtatttgtgcggtttggtaatggcagtttaagtgttaggggcataataatggtattcgattttttattaaattgtttataacatcaacaaataacaataaattagtaattttatcttgctattttttttatgacagatataatgtgatgcatatttcggacgcggggtggagcagcttggtagctcgtcgggctcataacccgaaggtcgttggttcaaatccagcccccgcaaccactttacatagaagttttcgtaaaggaccccactgtgacttggggtttttttatgcgagtaaacttgagatttagtaaacgggctgatagccctttttttacatctgtttgttatgaaatgtagaaaaaaactcaatcttacgtgttattttgagaggagaggatagtggcaacattagaggataaattacaagaattattacaaccttcagtagaggatttaggttgtgagctttggggtattgaatgccaacgttccggacgtttttttacagtacgtttatatattgataaaaaagatggcggtgtaacggttgatgattgtgctgatgtcagtcgtcaagtaagtgcggtgctggatgtggaagatcctattgcggataaatataatttggaagtgtcttcgccaggcttaaatcgaccattgtttacattaaaacaatttgagaattatatcggacaggatatttctgttcatttacgtgttcctatgtttgaccgtcgtaaatggcaaggtaagttagagaaaattgaaaatgatatgctgactttgattgttgataatcagccacaagtattagtttttggcaatattcaaaaagccaatgttgttcccaaattcaattaattagagagacaaaaatgagtaaagaaattttattagccgctgaagcggtttccaatgaaaaattgttaccccgtgagaaaatttttgaagcattggaaagtgcaattgcactttcgacgaagaaaaaatatgaacaagaaattgatgttcgtgtagtcatcaatactaaaaccggtgagttttctacttttcgtcgttggttagtggttgaaacagtactcaatccaacgaaagagattacattagaagcagctcaatttgaagatccggaaataaaattaggtgactatattgaagatgaaattgattcgattgcttttgatcgcattgcgatgcaaacagcacgtcaagtaattagtaccaaaattcgtgaagcagagcgtaataaaattgtggaacagttccgttcacaggaaggtgaaattgtttccggtacagtgaaaaaagtaaatcgtgattctattattttagatttaagtcaacaggctgaagctgttattttgcgtgaggatatgttaccgcgtgaaaatttccgtccgggtgatagagttcgtggtgtactatacaaagtaagtccggaaaacaagggtattcaattgtttgtgactcgtgctaagcctgaaatgttagtggaattgttccgtattgaagttcctgaaatcggcgaagagttgattgaaattaaaggtgcctcacgtgatccaggattacgtgcaaaaattgctgtcaaaagcaatgataagcgaattgatccagttggagcttgtgtcggtatgcgtggctctcgagttcaagcaattaccaatgaattggggggagagcgtgtagatattgtgttatgggatgataatcctgcacaatttgtcattaatgcaatggcaccggcagatgttagctcaattgttgttgatgaagataatcattctatggatattgccgttgaaccggaaaatttagcacaagctattggacgcaatggtcaaaatgtacgtttagcaacacagttaactggttgggtcttaaatgttatgacaatagatgatttaaatgctaaacaccaagcggaagataacaagattttagctttatttatgaccgcactagagattgatgaggagtttgctcatatccttgttgatgaaggattcactaatttggaagagattgcttatgttgctgtaaacgaattaacggcaattgatggcttagaagatgaggatcttgttgaggaattacaagctcgagcgaaaaatgcgattactgcaaggatgttagctgaagaagaagcattgaaacaagctcatgttgaagaaaaattattaaatttagaaggtatgtctcgtcatattgcatttagattatcagaaaaacaaattacaactcttgaagaattagctgaacaaggtgttgatgatttatcagatattgaagaattaagtgctgaacaagctgcagatttaattatggctgcacgtaatatttgttggttcaattaggaataaagagtaataagattatggcagatgaaataaaaaaagaaaatgcacccaaaaagttgagtattcaacgtcgaacaaaaactacagtgagtggaacaagtacaacgggaaaaagtaaagaggttcaggttgaggtgcgtaaaaagcgtacagttactaccgatcttgaacgtaaagctcaagaacaagccaaattaaaagccaaagaggaagcagagaaaagagctgctgaggaaaagcttgctgaaaaagcgaagcgagaagcggaaaaagctaaagctgatcaaataaagatagagaaagctaaggctgaacaagctaaagcaagtaagaaaaacgttgatgtagaaaaagaaaaacgtcgagcggaagaggctgaattacgtcgtaaagccgatgaattggctcgtcagaaggcagaagaaaaagcacaaaaagcggctgaagaagctaaacgttacgctgattttgatgatagtgacaatgataacggtaagttggatgattatagcgattatcacttaacttccagctatgcacttgaggcagaaaatgaagaagaacgtcgtaatgaaaatcgcggacgtagtaaaaataaagtagttaaagctaagaaaggtgggcgagatgatgaaaatggtaataaaaatgaacgtcaatcagatcgccgtaaccaaaaagatgtaaaaggtaagggaaagcacgctaaaaaagccagtgcgttacagcaagcatttactaaacctgctcaagttgctaaagctgacgtagtgattggtgaaactattactgtggctgagcttgcagcaaaaatggcagttaaggcaacagaaattatcaaaaccatgatgaaaatgggagaaatggtaacgatcaatcaagtgatcgatcaagatactgcacagcttgtagctgaggaaatgggacacaaagttattctacgaaaagagaatgaacttgaagaaatggtcatggaggatcgtgatgtaaatgctgaaaaagttcatcgtgcaccggtggttactattatgggacacgttgaccatggtaaaacttcattacttgattatatccgcaaagcaaaagttgctgcaggtgaagcgggaggtattacccagcatattggtgcttatcatgttgaaactaatgatggcaaaatgatcacctttttggatacgccggggcatgctgcatttacttctatgcgtgctcgtggtgcgaaagcaacggacatagttgttttggtagttgcggcagatgatggtgtgatgcctcaaactattgaagcgatccaacatgctaaagccgccaatgcaccattggtggtcgctgtaaacaaaattgataagccagaagcaaaccctgatcgagtagagcaagaattactgcaacacgaagtgatttcagagaaatttggtggagatgttcaatttgttccggtttctgcgaaaaaaggcttaggtattgatgatttattggaagcaattttgctccaatcagaagtcttagaattaaccgccgttaaagatggcatggcaagcggtgttgtcattgaatcttatttggataaaggtcgtggtccagtagcaactattttagttcaatccggtacattaaaccgtggtgacattgtcctgtgtggttttgaatatggtcgtgtgcgtgcaatgcgtgatgaaaatggtaaagatattcaatcggcaggtccatcaattcctgtagaagtactaggtctttcaggtgttccggcagcaggcgatgaagcaacagtcgtgcgtgatgagaaaaaagctcgtgaggttgctctttatcgtcaaggtaaattccgtgaagtgaaattagctcgtcagcaaaaagcgaaactggaaaacatgtttagcaatatggcagaaggtgatgttgcagagttgaatgttattgttaaagcggatgtacaaggttctgtggaagccattgttcaagcattacatgaattatcaacggcagaagtaaaagtaaaagttgtgggttccggagtgggaggaatcactgaaactgatgcaactcttgcagctgcttcaaatgcgattatggttggtttcaatgttcgtgctgatgcaacagctcgtcgtgtaattgaaaatgaaaatattgatttacgttattattcaataatttatgaattactaaatgaaatcaaagcggcaatgagcggtatgttacagccggaatttaaacaagaaattatcggcttggctgaggtgcgggatgtattccgtcatccgaaattcggtgcaattgccggttgtatggtaactgaagggctggttaaacgtaacaacccaatccgtgtattacgtgataacgtggtaatttttgaaggagaacttgaatctcttcgtcgttttaaagatgatgtcagtgaagtacgtagtggtatggaatgcggcattggcgtaaaaaattacaatgatgttaaagtcggcgatcaaattgaagtctttgaagtagtggaagttaaaagagcgatttaatttgtaaccggtaatataattttgttggttgaattatagctaaagagcgagattatcatatattaagttgcttaatgtttttgtggataagaatgcccttaactttgttttttaaggttaagggcattggagttttatcatgttttagaagagcaactgcgtatagtggtaaaaattaggaaaactcaccgctctttttaaggtgtaatttctcaactctagagtgaatttaccaacattaatggagaaaaatatggcaagagaatttaaacgtagcgatagagtagcacaagaaatacaaaaagaagtagcagttattttacaacgtgaggttaaagatcctcgtattggtatggtcacggtgtcggatgtggaaatatcaagtgatttagcgtatgcaaaaatatttgtcacttttttatttgatcaagatgaaaatgttattgagcaaggtatgaagggattggaaaaagccagtccttatattcgtagtttattaggcaaagtgatgcgtttgcgtattgtgcctgaattacgctttatttatgaccaatctttagttgatggtatgcgtatgtccaatcttgtgacgaatgttgtgcgtgaagatgaaaagcgtcatgtagaagaataagcgaataaaaatatgagtaaaccacgtaaaaaagggcgtgatattaacggtatttttttgttggataaatctcaagggatgagttccaatgacattatgcaaaaagttaaacgtcttttccaagcgaataaagcgggacataccggtgccttggatccgctggcaacaggaatgttgccaatttgtttaggtgaggcaacaaaattttcacaatatttacttgatgcggataaacgttatcaagttatcgctaaattaggcgagcgtacagatacttctgatgccgatgggcaagttgtgcaaaagcgagaggtcaatattgatttagcaaaaattttgaccgcacttgagcaatttcgtggtgaaattatgcaagtgcctactatgttttcagcattgaaatatcaaggcaaagctttgtatgaatatgctcgtgcaggcattaccattgagcgtgaagctcgtccaattagtatttttgagttgaagtttattgactatcaaataccttatttaacattggaagtacattgttctaaaggaacttatattagaaccttagtagatgatttaggtgaagtattgggttgcggtgctcatgttactaggttgcgtcggattgctgttgctgattatccttataacaagatgatgacgttagaacaattgcaacaattctctgaacaggaagatttggatttattggatcaacatttgttacctatggaaagtgcggttattcgtttacctggattgcacttaacaaaagaacaggcaagagctgtaggatttggacaacggattaagtttttaaatgaacaaggcatacaaggacaagtgcggttaatttctcctgaaaatttatttttgggtgttgctgttattgataaaaacagcattgtccatcctcagagaatggttgttattaaacccgaataaatccaaccgcacttaagggcagatttattctgcccttgttttgtcaattaagctaattccgctcgtaattttttagtgaccgacatcatcacttcaagttgtgcaatggtctctgaccagccacgtgttttcaagccacaatctggattgacccataaacgctcttttggtacaacgttaagagctttgcgaagtaaatgttcaatttcttctgctgttggtacacgaggactatgaatatcatacacacccggtccaatatcgtttggatatttgaaatcaccgaaagcggttagtaattccatatcggaacgagaggtttcaatggtgatcacgtccgcatctaaagctgcaatagccggtaaaatatcgttaaattcagagtaacacatatgagtatggatttgtgtatcgtctgctacacccattgagcttaaacgaaacgcctctcctgcccattgtaaataagtatcccaatcggctcgtttgagtggcaatccttcacggatagcgggttcatcaatttggatgactttgattcctgctttttctaaatccaatacttcgtctgaaagtgccacaccaatttgcttacataccgttgaacgtggaatatcgttacgtacgaatgaccactgtagaattgttacaggaccagtgagcatacctttcatcactttcttggttagactttgtgcatattttgaccaacgtactgtcattggttcaggacgaacaacatcaccataaattacaggcggcttcacacaacgtgatccatagctttgtacccaaccaaatttggtgaaagcaaaaccatctaataattcaccgaagtattctaccatgtcattacgttccggttcaccatggaccagcacatctaaatccaatttttcttgttcacgcacaacaagttcaatctcttttttcattgaattttcatactcttctaaagagagatcgcctttcttaaacgctgctcgagcacgacgaatttcggtagtttgtggaaacgaaccgatactggttgttggtaagagcggtagatttagccaagcattttgtaatttgatacgttcaccaaaaggtgatttacgttgatcggcattttttggcaaattagctaaacgttcagctacttccggacggtgaatttcttttgaatttgcacgagcatctgctgctacttggcttgcatctaattctacatttaccgcattacgacctttttcaagagcggtttttaagacgcttaactcttgtactttttgtaaggtgaaagctaaccagctataaagagcagggttgttctcttgtaattgggtttcaacatttaaatcaaatggtgtatggagtaaggaacagcttggagcaatccataaacgctcacccagtttttcttttagtggctctaatacatcaagtacagtatttaagttagctcgccaaatattacgtccgtcaattacgccggcagacaataccttgttgtaatcttcgaatgctactagttgctccggagcacgaactaaatctaagtgtaacccatctactggtaattcttttaataaagtagcgtgttctgttactgaaccgaaataagtagctaataataatttcgcattcactttttcagataacgttgcgtaaacgtctttgtacgcattaacccactcttttggtaaatctaccgctagtgcaggttcatcaatttggatccactcggcaccttctgccacgagtgcgtttaaaatctctacatacacaggaacaagttgagcgagtaattcaaaacggttaaaggattcgcctttctctttccctaaccataaaaatgttaaaggcccaacaattacaggtttaacttggtgtcctgcaactttcgcttcacgaatttggtttacataatgtgttgggtttgctttgaattgtgtgtctttatgaaactccggtactaaatagtggtagttggtatcaaaccatttggtcatttcaatagcaaattggtctttgttacctcgtgctaattgaaagtactgatcaagtgtcaaatttttactatcgaaaccgaaacgagcaggaatagctcctgttgcgacttgaagatctaaaatatgatcataaaaggtaaaatcacctactgccacaaaatccgcattagcatcagcttggtgtttccaatttttttcacgtaatgccttagctaaatctaatagatcttgctcagccaactctttacgccagtaacgctcttgagcgaattttagttctcttttggctccaacacgtggaaaacctaaaacgtggaatgttgtcataactaaatctcctgtatggtaagtacaattttgaatagacgtctaaacgtctgtgttttggtataatgcaataaaagtctttaatgatgcaatctcataattttcacgttttgtatgaaaaaaattaataaaagagcggtgtaatttaggtaagattaatagaaaaaagtaatgagcatgaagaagttgttattgaggcggttttttatgggcttggtttagcctcttcaacaggtgcagatagaacatcccaaatagatggctttggctcttcgggaatgtcattacaaaaaaactgatcgttatttatccaaacaggaagctttttaggacttgagcaattccagtttccataagagtctataccaatccattcaattttagctggtgtttgtggatttaacatttttatttcagcacgagataaataatcttgatagatttttaatgcaccactcgcaccggttaattttgttgttacattatcatctcgccctaaccatacagtaacaacattctcaccatcaataccaacataccaagtatctcttgattcatttgttgtacctgtttttccggcaagtttaagtgaagcgtattgattttgtaagctacgagctgtccctcgttcaacgacttgttgcatagcaaataaggtttggaaagctgcttcttggggaacgacttgttgtggcattattgaacgttggtaaatcagattcccctgcttgtctgtaatactgtcaagagttgacaacggaatatgttttccttcattggcaatagtttggaataattctgtaacctcataaggggaaatagagtaactacctaacaaagttgaaggcacgttaggtatttttacattatcccaacccattgccatttgcatttcaattactttgtttaagcctactttcataccaatattaactgttggaatattgagcgagcgaacaagtgcatctattagcatgacggaaccactgtattttctatcgtagttacgaggctgccatggctgagttcctttgatacgaattgtaataggctgattttgaataagcgtattaaggcgaaattgctcaggatcagataacgccgctaagtaaattgacggtttaactaaagaaccaatttggcgacgagcgtgtaaagcacggttaaatcccgcatagtttgtctgtaaaccgccaacaatggcttttacttcacccattttataatcagcaataatcatcgcactttctaaatgtggatttttatattttcgctgtaattctgaaactgcttttatcacggatttttctgcatgttcttgttgtttcggatccaaagtagagaaaattcttgcaccggataaagaggaaagtttgttttcgcccagtttgcttcttaattcttgctgtagagtttgaataaatgccggatacttgcggttaatttgtcctcttttttgtacgccgagaggacgtttactgagtaagtcatagagttcattactaatcattttatgattgagcattaattttaatacaacattacgacgttctaaggccttttgagggttacgccaaggattgtatagtgaaggaccttttaccatgccaaccaacaaggcaatctgatccaaactgatttcccgaacaggtagcccaaaataaaaatggcttgccaattcaaatccatgaatttgtgtgttgccattttgtcccaaataaatttcattaaggtaggtttctaatatgcgatttttatcgtaacgaaaatctaaaatcaaagccattaatgcttcattcattttacggcttaatgtgcgttcgttgcttaaaaataaatttttaaccagttgttgtgtcagtgtacttccaccttgtacattatgtcctgctttgatgttggtaattaaagcacgaataatgccaagtaaacttattccatcatgttcataaaaatggcgatcttcggttaaaagtaaagtatcgatcaataatcttggataatgttgtagcggaatagctagacgttcttctctatctgattgcaacatcgcaataagttttggatcaagacgaaactcactgatggtttttacattgatcaggtcttcaataatagaaagtttattatcattattaaaacgtaggcgaaaaaggcgttgtgcttcaggttgatttgggaaagggaaggctctgcgtaaaataaccaaagtgttattttcaattttaaaatcaccgggcgtggcaagcatggttgtttggcgatattcattttctaacagtgcttgtttgatttgttccagattcagttgatcagataaacgtatgttttcaatacggctataaacctcggcgggtaactgccaaatttgaccatccattttattgcggatttttccgtctaaataaataccgtaaaatgcaattccacataatagagtaaaaccaagttttgcactaaaaataaacaaccgttgttttttatttttcttttttggttgagttgtatttcgtttttgtttcgcagccatttttatttagtttaagcaataaaagagagataggattttagaaaatattcaaaatcttctaagccacaaaaagcaatactttcttcatcataataatggaaatcagcttccagttcatcgtgttcttcaattgctaaattattggctttaatcataacttcatctgaatgaataaaaacagaaaattcgtttccaatgagactaaactccttttcattgcgtgattgttttgcttgttgcagataattaagtgcggtaggaatcaagtcagaatttaaccgcacttctatattgaaccaattagctattgcctcatgttccatagaaaaattaactgttacttgatcagcgttgtgagtaaattgatagtccattatttagatgctaaaagatgagccacaaccgcaagttgttgatgcatttggattgttcacaataaatcttgagccttctaaaccttcagtatagtccacagtaccaccaactaggtattgtaaactcattggatctacaaccaatttaacgcctgaattttcaacgattaaatcgccgtcattggttttttcatcgaaagtaaagccatattggaaaccactacaccccccaccggtaatataaacacgtaattttaattctgtattttcttcttctgaaattaaggttttgactttattcgccgccgcatcagtaaatgttaaaggaactgcaagatctgccataatattttccgataataaaaattgatgggttattatctaataaccaactaaaccattcaagatttataaaaaatttaatgttataatatgcgacaaattttatgtttagagaagatattatggcgattccattaagaacagaacaagaaattataaagttacgtacagcctgtaaattggcggccgatgtattggttatgattgaaccttatgttaaggcaggcattacaaccggtgagttagatcgtatttgtcatgaatatattgtgaacgaacaaaaggcgattcccgcctgtttaggctattacggctttccgaaagcaacttgtatttcattgaatgaagttgtttgtcatggtattccgactgaaggtaaagagttaaaaaatggtgatattgtaaacattgatgttacggtgattaaagacggctactacggcgataactcaaaaatgtatattgtcggtgaaaccaatatccgcagtaaaaaattagttgaggcggcacaagaggcattatatgttggtttacgagtggtgaagccgggggttcgtttaaatgaaattggtagagcagtgcaaaaatataccgagagtcaaggcttcagtgtagtgcgtgagtattgtggacatggcatcggtaccgaatttcattgtgatcctcaagtgttacattattatgctgatgatggtggtgttattttacgggagggtatggtttttactattgaacctatgattaatgcgggcaaaaaagaagtgcgtttaatgggcgacggttggacagtaaaaaccaaagatcgtagccattctgctcaatatgagcatcaacttgttgtaacgaaagatggttgtgaagtgatgacgattcgtgaggaagaagaaaaagtcggacgaattagtagaataatggttaatagataatatcaattcgaaatgcaatctttttaaggttgcatttcttttatttcaggacatgctatgttttcttatcttccaattccaaatccaacgatagcaacaataaaagcacaaaaagagcaactcaaacaatttgagttgacacattttcagcaattttctgttgatcagcttattcataatcgttcagtattttgtgatcaattattaattcatttatggcaattttttcaatttgagcaaaatcatttagcccttattgctgtaggcggttatggacgagaagaactttttcctttatcggatcttgatgttttgttgttagttgaacatgaacctactatcgagctggaagaaaaaattgcacatttttttcagtttctatgggattgtggatttgaggtcggacattcagtacgcactttagggcaatgtgaacaaagtggacgagaagacatcaccattgcgaccaacttattagaaagccgatatttatgtgggcaacaagatttattcgaaaaattaaccgcacttttgcaacaaaaaaatttttggcgaaatgaggatttttttaatgctaaagttgcagaaaaagttacacgctatcagcgttaccataataccggttataaccttgaacctgatttaaagtatagtccaggaggattgcgtgatttacatcttatttattggttggctttaaagcatataggtgctaaaaatttagaagatattttgcacgctggttttatttatccacaagaatattctttattaaagcaaagtcagcaatttttatttcaagtgcggtttgctttacatttaattttaaaacgttatgacaatcgcctgttatttgatcgtcagcttaaagtttgtgaattattaggttttgttggtgagggcaatcaaaaggttgagaaaatgatgaaagtcttttttcaagcttcacaatctatttctgtattaagtgatattttggttaaacattaccaagagcattttttagccggttcacaaattattgagcaacaagttttagattccgatttttatcttatcaataatgcaatttgtgtaaaaaatcctgatatatttattcaaatgccggataaaatattgatgctattttactatttgacacaacactctcatgttgaaattcattctgcaacattacgcaagttgtatattgttactcaacaatttactgggaatttatctgattttcctcttgcaagagaacgttttttacgtttattttcacaacctaattctatttctcgtgctttgttaccgatgcataaatacggtgtattgaacatttatttaccacaatggaaagggattaacggattgatgcagtttgatttatttcattcttatactgttgatgaacatactttgcgagtgatgttaaaattagaagagtttttagcggaagaggcgaaaaaaaattatccgatctgccacaccattttctcatcattaactgaccgcactttattatatcttgccgctttatttcatgatattgcaaaaggcagaggaggggatcatgctgaattaggtgcagttgatatgcgtatttttgcacaacaacatggctttgatagtcgagaaagtgaaactatggcatggcttgtacagcgacatttgcttatgtctgttactgcacagcgtcgagatattcatgatcctgaggttattctcaattttgctgaagaagtacaaaataaagtgcggttagattatttaacttgtttgactgtggctgatatttgtgcaacgaatgaaactttatggaatagttggaaaagatccttatttacgactttataccaatacagcctagatcagtttcaacaaggaatagatattttattaaatcatcaagaaaaagctgaagaaaaccgcaaacaagcgtgtattttattacaacaaaagtatggatttttatctgaagctcaaattgagcagcactggcaagattttccttgtgagtatttttggcgtaatagcccgaagcaaattgcttggcattctgagttgttacttgataataatcaagatttattgattaaagtcagtaatcgtttttcttatgcagggacagaaatttttatttattgccaagatcaagcgaatttattttataaagttgccagcattattggagcaaagaaattgagtattcatggagcacaaattatcacaggaaaaaatggctatgtattcgatagtttgattgttaccgagttggatgggggcttgctgaacaatgatcgtcgccgtcaattggaaggtgcattaattaaaggattaaaaacaaacaagattgttaacccagttcgtataaataaccataaattacaacatttccatgttaaaacagaagtcagatttttaaatgttcataagcaagaacaaactgaaatggagctttgtgctttagatagagcaggtttattagcagaaattagtcaaatatttgtacaattggagttgaacttattaaatgcaaaaatttctacaattggtgaaaaagtagaggattttttcattttaaccaataagaaaaatgtagctttaacggaacaagaaaggttacgtttacaagatcgtattgaaagtaattttagctaaagataaatgtctacattgcatagattttttatgctaaaatccgcaaccgatttattttattgctgaataggaaaaagaatgaaggttttagaaggtatagttacagcacctaatgccaaaattgctgttgttattgcacggtttaatagttttattaatgaaagtttattagagggagcattggacgctctaaaacgtattggtcaagttaaagatgaaaatattactttagttcgtgtaccaggagcttatgaattgcctttaattgctcgtcgtttagccgatagtaaaaaatatgatgccattgtagcgttgggtactgttattcgtggcggtacagcacattttgaatatgtagcaggtgaagcaagcagtggtttagggcaggttgcaatgcaagcggaaattccggttgcatttggagtattgactacagaaaatattgaacaagccattgaacgagcgggaactaaagcaggtaataaaggtgcggaagctgcattagttgcattagagatggtgaatttattagctcaaattgacaaggcatagtagataaaatgacagaaaaagtaaaaaaactatccccacgtcgtcgagcaagggaatgtgcggtacagaacttgtattcttgggctatttcaaaaaatgcacctgaagaaatagaattaaatttcattgtggatcaagataatgaaatgaagggcgtagatatgccatatttcagaaaattgtttcgtcaaacagttgaccatgttgaaattgttgatagcataatggcaccttatttagatcgtaataattttgagttagatcctattgaatgtgcaattttgcgtttagctgtttatgaattgaaatttgagttagatgtgccttataaagtggtaatcaatgaagctattgaggttgctaaagtatttggtgcagaagaaagccataaatatattaatggtgttttagataaaattgcacctgcactttctcgtaaatagataggtttatcataatgagcaatggcgaatttgatattattcaacgctatttcatcggatcaaaacgtccacaacgtaaagatgtgattgtttctatcggtgatgattgtgctattactgaacattatcaaaatcagcgaattgctattacgactgatacgatggtagaaaatgtccattttctgtcttctattaatccttcggatttagcatataaagctgttgcaacaaatttaagcgatcttgctgcaatgggggcgactcccgcatggttttctcttgcaatcactttaccttatgttgatgaaaaatggctcaatgaatttagtcaaagtttatttgatgtattggatcattataatgtgtcgcttattggtggagatacagcaaaaggtcccgtatatacaataactattactgcacaaggcatcgtacctaaagggaaagcactttgtcgccacagtgcacaagatggtgactggatctatgtttccggcacattaggagacagtgcggcaggattggaattactattaaaaaatacagaggaaacgcatagtaaaagtcatcaaagtgcggttgattctgcacaagaatatttaattcaacgccatttacgtccaacccccagagttttgcttggtctggaactagctagtgctgagttggcaaatgctgcgattgatatttctgatggatttattgcagatttaggacatattttacagcgtagtcaatgcggtgcagtgatcgatttagataaattacctttatctgagcaattaatcaaaactgttggtatagagcgagcggagcgatttgctttaactggcggagaagattatgagttgtgctttacagttcctgatcgcaatcttgaaaagttagagcgagctttaacccatattggtgtgaattatagctgtgttggacaaattcgtaataaaaaacgtatcacttttcaacgcagcggtaaaaccgttgagattggttcattactcggctttgatcattttaaataagatttcattatgacaaataatcctttatctcgtatttctttaaccaatcctattcatttttttgcacttggcttaggttcagggcttattcatcctgctcccggcacttggggtacccttgccggattaattgttggttgtttgctattacagataatgtcggtgttttcttttgcaattttcactgcactttgttttttattaggatgttatttgtgtcaacaaacagcggatgatatgggcgtacatgatcatggctcaattgtgtgggatgagttcgtcggtatttttaccgtgttactctctattcctgaattatcattgatatggtgtagtattgctttcgttgtattccgtatttttgatattttaaagccttatcctattcgttattttgatcacaggttagaaagtggcttcggtattatgttagatgatgttttagctgctatttatacggtcataagcatttctatcttaaatgatcttgtatagaggcgattgattatgctgaatttattattggttaatttattcgggttacttaccccgggacctgattttttttacataagtcgtttagcagctagtcattctaagagaaatgccatttgtgctgcgtttggtattagcttgggttgtttagtttggtcaacttcagcaattcttggactggctgttttattgacaacttacccaagtttgcaaggtatcattatgatgctaggtggcggatatttggcttaccttggtgtattaatggtgaaaagtcataacaatattgtctttgataatcgtgaacaagcagaaaatttaagaaacagtatgggtaaagaaatcttaaaaggattattgattaatttatctaatgcaaaggctattatcttctttagtagcgtgatgtcttttgtattggttgatttaactgaaacatggcagattattaccgcacttattttattaactcttgaagtatttttgtatttttcttttattgcacttattttttctcgtaaaaccgtaaaaaaattttatagccaatatagccattatattgataactttgcagggatcttttttctttgttttggcggttatttaatttatagtggtcttttcttaggatttggcaattgataaatagagagggataaaatgacgttaaaaattggtattgttggttcgggtggtcgtatggggcgtcaactgatacaggcagtatatcatactgaaggcgtagaacttggtgcggcatttgagcgtgttggttcatctttagttggaactgatgcgggagaactggctggaataggtaggattggtattaaagtaaccgataatttaactcaagaaaaaggtaactttgacatcttaattgattttactcgagcggaaggtaccattcagcatttagcattttgtgtagagcaacataaaaatatagttatcggtacaacagggtttgatgatcaatccaaacaagctattcaacaagcagcacagaatattgcaattgtttttgcctctaattatagtgtgggcgttaatttagtttttaagctgttagagaaagcggctaaggtcatgggcgattattgcgatattgagattattgaagctcatcatcgtcataaagtagatgcaccttccggtactgcactatctatgggggaacatattgccaaaacgttaggcagagatttaaaaacgcatggcgtgttttctcgggaaggtattacaggtgaacgtaagccggatgaaattgggttttcaacaattcgtgcggcggatgttgttggtgagcatacagtatggtttgcggatatcggtgaacgagtagaaatatctcataaagcctccagtcgaatgacttttgctaatggtgctgtaagagctgcaaaatggctttctactaagcaagaggggctttttgatatgacagatgtactggatttaaataatctgtaagtgcggttagatttggttcttgaaaattgcacatctttgatctttcagtatttgtcatttaagatgttgctaagatgttgatggaataaaatcaatgccaaaattttagccagtccgaaaaatgggtataatgcccactgatattatatattttaggaatagtagtatgaaatttatttcatttaatattaatgggttaagagcaagacctcatcaacttgacaggattgtagagaaatatcagcctgatgttattgggttacaggaaattaaagtgtctgatgaagactttccctatcatcttgttgaacatttaggctaccatatttatcatcatgggcaaaaagggcattatggtgttgctttgttattgaaacaagaacctaaagtaattcgtagaggcttttctactgacgatgaaaatgcacaaaagcgtataattatggcggatttagaaacagattttgggttgctaacagtaattaatggttattttccgcaaggtgaaaaccgccagcatgaaacaaagttcccagccaaagaaaaattttatgcggatctgcaacattatgtagagcaagagcatgacagaaataatccaattttaattatgggggatatgaatatcagcccgacagatttagatattggtattggtgaagaaaatcgaaaacgttggttgcgtacaggaaaatgctcatttttaccggaagaaagagaatggataaatcgtctatataattatggactgattgatacatttcgtcataaaaatccgacaatcaatgatcaattttcatggtttgattaccgctcaaaaggctttgatgataatagagggttacgaattgatcatattttagtgaatcaattattattagaacgttgcgttgatgccggtatagcttttgatattagagcgatggaaaaaccatctgatcatgctccgatttgggcggaatttaagtgaggaacatagaatgggaattgaacaagaatggcaaaattatcgatctaaaattaatgataaattagccgtattttcagttaatttaaaacttcttgaacaatttccagtcgtaaatcatatatgtgaaattgttgtccattttgaagtcccttatatttcagatgcacaaggcttaccgcaaatagaaagttacgccggtttgcaacaagatttgctcaaaatatccagtttaatttctgcccaacctaatgtttattacgcaggcaatattctttgtaatggcaatgctacattgtatttctattgtaacgatgctttagatattacagatgtattatctgataattttccaaacgctgtaaatattgagaaacaattcgattcaacgtgggatctatattttgattttttgatggcatctcaggcagatttgaaagtaaatgcagcagaagaattattggcaactttaattgaaaaaggagaagatatctcgaaaagttatcaaattgagcatactttttacttttacaaagaaaatgatctttacttatttttggagaatattgctacttctgacatatcatttttatcgctaaaacattcttctaagcaaataagtgtgaatggatataatgtatatattgctaaaatagagcaagaattatatttaaatgatgccagtatctatgaatatataagaaattttgaagaactcgctttgcaacattcaggtgaatatattggttgggagagcgaagatattggtataaataaaaatcaactaaattaatttttaaatttaaaaaaccttacaacagaataagatgtaaggtttttaatcggattaaagcaccttgacaatactttcacataaataacgaatattatcttcagttacaccggctaaattaatacgtcctgaacgcacagcataaatggcaaattcttcttttaagcgatccacctgttctgcatttagaccactaaaagagaacatgccattttgttcaataatgaagctaaagtcttgcttggcaccatattcttttaataattcaacgaattgataacgcatatgtttaatgcgattacgcatttcggttaattcggattcccattgttgacgcaataggttatcacctaaaataatagaaacagctgtagcaccatgagaagcagggttagagtagagagtacgaataattgatttcacttgtgttaatgctattgctgaaatttcttctgtttctgctactaaagtaaacgcaccaacacgttcattgtataaaccaaagtttttggaataagaacttgcgactaataattctttatgattttctgcaaaagttcgcaaaccaacagcatcttcttctaacccgttagcaagaccttgataagcaaaatcaaagagcggtaaccaaccatttttttctgacatttctgctagtattttccattgctcaggggttggatcaatacccgttgggttatgacaacaaccatgtaacaacaccacatcaccttcactggcattgcttaagtcagcaattaaattatcccaatctaaagcttttttctctgcatcgtagtaacgatattcacggattgtcatacctacagcgttgaaaatagcattatggtttggccaagttggtgaactaatccaaacgttttgagatgtggtttgacgtttgataaattcggcagcaatacgtaacgcaccagttcctcctaaactttgtactgttttagcacgtccttgtttaataattttagaatttgtaccaaataataattctttagtgtatgaattaaattctgcaataccatcaatagttaaatagtttttagtggtttctaattcaaatagacgattttcagcttctttaacagctttcataatgggggtgttaccattagcatctttatagaccccaatacccaagttaattttattggcacgcgtttcagatttaaaagcctcacctaaacctaaaattggatcagcgggtgccgcattaatattctcgaacatagtagtatcctcaataaatagttgtgtttgaatagatttctttatacttgtaaaaacttatctttgcaaccctttagctaagttaaatttaattatttaattttaactttataaaatatattaaaaattatttgctagattaaattatttcaatttttccaatgtccaatctaaaccaaattgataatcttgcggtagtatgtagcgtaatttttgtaaattatctattaaaatagacggagttggatgagataaattaagatgcccaactttacgaccttctcgtatttcttttccataccaatgtaattgtgaaaatggcaaatttaaccattgtggattatgttcagtgccaattaaattcaccataaccgacggcatagccacttgtaaatcaggcgtaggtaaatctaataacgcacgaagatgtaattcaaattggctaatcgaacaacctaattgcgtccaatgtccgctattatgtactcttggtgccaattcattgactaataattgatcttgcacaacaaaacattccattgccattacgccaacataatctaatttatccataattttagccaacattatttcggcttgtttttgttgttgtgactgttgtggaaaatttaaattcatgacactgtaacgtaaaataccattctgttgcagattatgcgtaacaggataaaaacgagttttgccatttttaaaccttgcaccaaccaaagaaatttcataatcaaaaggaataaatttttcggcaataacttcgccaaaaagctcattgccgattacatcttgattgtttttatctacaatccattgtcctcgtccgtcgtaacctcccatgcgacgttttacaacaactttttcaccaatttctgtaaaaatagtgaaaaaatcctccgcactttgtaccaacctccaaggggaagtaggaatatttagtgcgttaagcaaggttttttgtgtaaaacgatctgctgtagtggcaaaaattttttgattaataaatttatcgtgattagccaacatttctgtaaggggtgttttttcccaacgctcaatttctgctgtaataatactgttagcaggcaaatcaaaaacaggtgcatcaaaagcaagaggttggacattaatatctaaaggtgcaccggcataacgcaacattctgcccaattgcccattgcccaaaacatacactgtgggatataaagtgcggtttaccattaaatgatccttatacttaattaagatattgtaaatttttatttactctgattttacttgatgaggttttagtagtaactcatcttcgttcaatttaaataatttggctattgtatcacgataggatatttctaaagtttctcggctggttgccgttacaccttgatcaattaagaaaccgtcgttaacatcataaatccagccatgcaaagaaagtttttttccacttttccaagctgatttaacaatagatgagctgcctaagttatacacttgttccgcaacattaattcttgtcaacatatcagcgcgtttttcaggagataacttacccaataaatgaccatgtttaaaccaaatatcacgaatatgtaacaaccagttattaatcaatcccaaatcttgatccaccatagcggctttaatcccaccgcagttggtatgtccgcaaataataatgtgctcaatattcagtacatcgacagcatattgcaccacagataaacaatttaaatcagtatgaataacttgatttgctacattcctatgcacaaataattcaccgggttttaaatttgtcaaattttcagcaggaacacgactatcggaacaaccaatccataaatagctaggtgtttgattttctgctaacgctttaaaatactcagcattttcttctttcatcctatttgcccaactaaaattattggcaaataactgttcaatttttttcatttttttaccgctcctaaagatgcacagtatagcctagaatagaaaaacggtaaaataaaaagccctgtaagataacagggcggcgaaatttaggtaggattgaatatcatcacaacaatgtcgcttgtttcattttctgcacgaattctgccaattcggagaggcatttttcttgatctgtgagattttgttcaatgatttgcactatagctgaacccgaaattgcaccagcaacacctgattttaacgcatctttaacttgttgtggttgagctatgccaaaaccttgtaaaatcggagctgagccatatttttttaagtctttgatgagattagctagatttttcgcactttgttgattttcagcacttgttacgccggctcgagaaactaaataaatgtagcctttgcttttttccgccactgctttaagggttgtttcatctgcattgggtggacagataaaaaccggttgaatgtcatatttttgagcggattgaatatacggttcagaagcaagcagaggaatatcagccaccaataccgcatcaactccgacttcagcacagcattgataaaatccatctaaagtttgagcataaattaagttggcacaaaggagtagactgatcggaatatcgggatatttggaccgcactttggcaattagttgaaaactttcttttgtactgcagcctgcgtttaaagcacgatgattagcagcttgaataaccgaaccgtcaagtaaaggatcggagaaaggaaacccaagttccaaagcgtctgcaccgttatccactaaggtacaaataatttcaaaagagcggtcgaaatttggatcgcataaagtaacaaaaggaacaaaagcaccttgtttttgcttttgtagttgtaaaaatttttgttcaaaatatcccatcagataattcctttctcggttaaaattttatctacagtaaaaatatctttatcgcctcgacctgataaatttactacaagtaattgttctttttccggattttgtgcaatgagttttaacgcataagccaaagcatgtgagctttctaaagcaggaataatcccctcatgtttggctagggcttgaaatgcctcaagtgcctcatcgtcagtaatactttcatattgagctcgtccaatagcatgcaaatgggcatgttcaggaccaacggacggaaagtctaagccggcagaaatagaataagattcctcaatttgtccgtcttgagtttgcataatcggggatttcataccaaagtaaataccaatagatccatgacgaagcggtgctccatgctttcccgtatgaataccgttgccggcaggctcaattccaattaggcttaccgatttttccgcaataaactcagcaaacataccaattgcgtttgaacctccgcctactgcggcaataacggcatcaggtaagcgattttccttagctaaaatttgacgtttagtctcttcaccaatcattttttgaaattcccgcacaatggtcgggaatgggtgaggtcctgctgctgtacctaataaataatgggttgtttcataattagctgaccaatcacgcatagcctcacagcaagcatcttttaatgagcaagagcctttttcaacaggaatcacctctgctcccattaaacgcatacgaaatacattcggcgattgacgctcaacatcttttgcccccatataaactcggcaaggcatatccaacatagcacaagctaaagccgttgctacaccgtgttgtcccgcaccggtctccgcaataatacgtgtttttcccatacgttttgccagcaaaatttgccctaatacttgattagttttatgtgcacctccgtgaagtaaatcttcacgttttaaatacaattttgtttttgtacctttagtgagattgcgacataaagttaatgctgttggacgacctgcataatttttaagcaaatcttgaaattcttgttgaaatacaggatcgtgccgtgcttcaacaaacgctttttctaattgttttagtaccggtaccagaatttccggtacatacattccaccaaattcgccaaaatagggatttaaaattgtatccgtcatattttttccttattgattttggattttgccaaaaactgtttgtaattttatttgatcttttatgccgttggcacattcaacacctgaatttaaatcaatccctagacagtgttgctgcaatgcttgttcaatattttgaatatttattccaccggcaagcatgactttatatttaatggagggaggaatacaattccagttaaaagtttgtcctgtgccgccttgtcggttatctgctttactatcaaaaacatagcgatctacataaggaatttcttcaaaatctaccgcacttttcccttgttcatattgctcggtaacgttaatcgtaactgctttccaaatttgacattgtgtaggtagaacttggcgaagtgcggtaataaattcagcattttcatcaccatgtaactgcacggcgaacaattgtaattgtgtagcaatgttatggataaacgcaatagactgattttggaaaacgccaacaaaaagcaaaggtgcttgcttaaccaatttctgtgcttgacatagggagagtttacgaggagaaccttcagcaaaaatcaatccgccgtataaagcaccttgagcatagcttgctttgacatcttgtcctcgtgttaaaccacaaactttgtgttcacccaaaagtaccgaacgtacggcattgttaagatctttaccactagttaaactgctaccgattaaaaagccatgtacataaggttttaattgttgtacttgttgatgagaagaaatacctgactcgctgatcacaatgcgatctgccggaatttgtcttgccaaaggaggcgtgcggttaagatctacggagagatcgtgtaaatttcgattattaattccaattacttttgcacccagttttatggctcgttctaattccttttggttggatgtctcagttaaaacgcccattccaaggttatgtgcaagatcagataaagtgcggtaagtttcatcatcaagtatcgacaacatcaataaaattccatcagcttgataataacgtgctaaatacacttgatatttactcagtataaaatctttgcaaagaataggttgagtagcctgcttacgtactaaaggcaagtagttaaaatcgccttggaagtatttttcatccgttaaaacagaaattaccgaagcataatttttatagacatttgcaatttctactatattaaaattagaacgaattaaacctttcgaaggtgatgcttttttgcactctaaaatgaaagcggggcgttgatgtgtaccttggcttaacgcttgataaaaagagcggtcggatttttttattttctgttgaaattgtgcgagaggaaacgacgattgtttttctgcgatccattgttttttatcttgtacaattttttgcaaaatagaagggatattgtgttgcatgataattcctatttattgatacgtttttaattggtttaatgtttcaaatgcttcaccgttcgccataatatttaaggctttttctgcattggctttaagatcatcattgccaaataatttcattaataaggcaacattcatagcaacagcttgattatgctcatctttgccttttccttgtaaaagtgcggtcaatatttcggcattttcttctgccgtaccgccacgtaaggtttctaatggtttaggagtaaaaccaaagtcatgaggtgttaaactataatattcaatttttccatgacaaatttccgcaacatcggtttttccatgaatagcaacttcatctaaaccggaaccatgaataacaatactatgctgatgccctagtcttaatgcactttcagcatagattttaagtaagtgcggtgtataaacccccagtagttgatgttttgggcgagcgggattgcataaaggacctaaaatattgaaaatcgtgcgtgtttttaatatttgtcgtacaggtgcgacatgtttaaatcccagatgatattgttgtgcccagagaaaacaaagattgagattatctagggcttgtttggacttttcagcagataagtcaatttttatccctaaagcatttaatacatcacttgcaccgcttttgctggatacacttcgattaccatgttttgccactttgtatcctaatgttgcagcaacaattgccgcagtagttgaaatattgatggtattagcattatcacctcccgttccgacaatatcggcaaaagggtagtctatgaatggaaatggcttagcgttggcaataatggcttttactgcaccgctaatttcatctgcttgttcaccacgaaattttaaagcgataagtacgcctgcaagttgttcattagaaagttgtccttgaataatataatgaaataactgttgtatttgttcttggtttaaatgttgtccgtcgaaaagttgactgattaattgttctgtttgcatgttattttccttcttatttttcgttctattttgacgtcggtaaattataaatcatcatattgttctctacttttagccaatagccattgaatactttgctctaataactgtgagccttgcttcgttaatatactttcagggtgaaattgaaaactgcaaataggcaaggttttatggcggatagccataatgatgcccttatattcagcattaataataaactcttccgaaatttttcttcccattaaagaatgataacgagcaactgacataggattatctaaaccctgaaacatcatttggttatcatgataaatatttgatactttcccatgtgaaatttcaccggagggaacaacttctccaccgaatgcttcaatcaaagcctgatgccccaaacaaatgccaatcatagctactttaccttttagtgtttgaattaaaggcaataaaattcccgcctgtgcaggagtacctggccctggtgagagggctaaaacagtctctttttctgctaaaataatttgagttaataactttaaatcgaagttattgcaaaaaacttgtacttgatgccctaaactgcggaattgatctactagattgtaagtaaaggaatcaaagttatctaaaaatataattcttgccatattgtctccttagtcttgagtattggtttgcaatattgcattaatcacagctttagctttgtgacgggtttcatcagcctccatttgtggatcggaatctaagacttcaccacaacctgcttgaatataagcaataccttgttgtacaaaagcggaacgtatcacaatacaggtatcaaaattaccatcagaagataaatatcctattgcaccgccataactatgacgcttttgtttttcaacttggtaaattaattgcattgctttaattttcggggcaccagttaaagtccccatattcatacaagcctgataagcatgaaaggcatcaagctcggggcgtaattttccgactacacgagaaacaaggtgcataatatgagaatagcgatctacttgcattagctccttaacctgtcttgtaccgctttcacagactcgagcaatatcgttacgagcaagatcaacgagcataagatgttctgcgagttctttcttgtctaaacgcaattccaactccaaacgagtatctaattcaggatcgacattaccctgttgatcaaagccacgagaacgagatccagcaatcggataaatttctacttggcgattttcagcattatatttcaatgcactttcaggagaggaaccaaataagatgaaatcggtatcttgcataaaaaacatataaggacttgggttattgttctttaattgacggtagctggccaacgtatttgggcattccagcataaagcgacgagaaggaacaatttggaaaatatttcctgcataaatatgctgttttaattgttcaataatggttttaaaagattcgtcttctaaatttacttgtactgcaacactcgcttttgagacagctaagtgcggttcaattttcgttaatttttgacaaatttccatcgcacttttttgcacattacctaattcttgcgaatgaaaacagaatgattgtagagtagtttgttgtaattgatgatcaatcaccaataaattttctgccaaataaaatacatagtcaggacaggttaatccatcatcttctaggctaatattttccattggtataaaattaattactaaatcataggcaaataatccccctagaaaaatgggtattttggattgagcataaatatctgttaaacaacgtaacccatcaaaaacggttgttgcctgtaatttgctatcttcatcgagattgggattaatcggagggataataacttctaaatcgctttcagacttcacaagtatttttgctgttggctgtaatttttctttaataagaggtaaaactgtttttccattgctggttaaagcgttaaatataatagtattaccgaaacaagatattttgattgcggaatttacaaacaataggctttttaaactatttttactggagatttccgcactttctaacaacaaagtattagttttttgttgacaaagtgttgcaaaaactgcggtaggatctttgtgataaggtaacttctgagttaatacttcaataaagggggtaaacataaaagaatccttatttagaataaatttaaatatgaactattaaactagtacagatttgttttgtcaatagtgaagtaacattattttaaaagtaagtatttgaaataaaaaaattgcaattttcttgcgagaaagcataagcaataaaattgcacttttaaataaattcgttatgataatcggttcataatttcacttatataaggaagaaaaaatgtggtctgagttattgattggttatggcttgtttatcttagaaatactcacaattttattaattgttgcagggatagtgatgatgattatgacactgaaagaacgtaaatcacatcaagtcggagagttggttattacagatttatcacgagaatatgaaaataacagtaaaaaattgcgtgatttttacctgagtgacgatgcgttaaaacaacgtgaaaaagagcagaaaaaagccgataaacttaaagcaaaagaagaaaaagcccaacgtaaaaaaggggaaacgttagcagaaaaaagaaaaccacacctttttgtattgcattttaaaggtgatatttctgcttcagaaaccaccgcacttcgagaagaaattagtgcgattattgcggttgcaaaagaagatgacgaggttttattacgcttagaaagtcccggtggagttgtgcatggctatggattggctgcttctcaattagctcgtttaaaacaacgcaatattaagctaactgtagcagtggacaaagttgctgcaagcggagggtatatgatggcttgtgttgcagataaaattatttccgctccttttgccatcattggatctattggtgttgttgctcaaattcccaatattcatcgcttattaaaaaaacatgatatagacgttgatgtaatgactgctggtgaatataaacgcacaatgaccattttgggtgaaaatacagaaaaaggaaaagaaaaatttcaacaagatctagaagacactcatttattgtttaaacaattcgttacacaaaacagaccgcacttggatattgataaaattgcaacaggtgaacattggttcggcaaacaagcattagcgttacatttagttgatgaaattgcgacgagtgatgatttattgttacaagcaatcaaagataaaacagtgctttcggtaaaatatatgatgaaaaaatcactcattcaaaaattaggcaaacaagcagaagaaagtgctaataatgtgttgttacgattgctgaaacgtgatgagagtactttgatataagcttactcaacattgcccaaaaagagattaaaatttggtttacatttttgttgtttgatattaatatctcaagcagtgctgacgtgatttaatgcgacaatatttttgtaaagatagaaaattaaatcgtaagctattcaaaaaatttgaagaaatttatatacataaaattaaggtaaaataatgaaactatcacgttttgtattatctgctgttgtagcagcaacattgtcggcttgtggtaatttaagtaatgtcaccgaagagggtacatcagataacttgaagtggcctaaaattgatcagtcaagatttaaccatgatggtagccaatttggatcgtggccaaactgggataacctacgtatggttgaacgtggaatgaataaagatcaactgtataacctattgggacgtccgcatttttcggaaggtttatatggtgttcgtgagtgggactatgcttttaattatcgtgagaatggcgagcataaaatttgccaatacaaaattttattcgataaaaatatgaatgcccaaaatttctattggtttccaaatggttgtaacggttatgcatcttttagtttaaatacggatctcttatttgattttgatcaagatacgttgacctcaaaaggtgaagaagctgttgataatgttgcaatgcaattagaagcgttttcagctaaagaaattaaaattgttggttttactgatcgattgggtacagattcttataacttggatctttctcaacgccgagctgatcgtgttaaagagcgtttaattgaaaaagggttaaatattgatattatcgctattggatatggtgaaacgcaacagattaaggcttgcaatgatgtgccagctaaagaactaaaagattgcttacgtccaaaccgtcgtgttgaaatttcagcatacggaaacatctcaaaaaaatatggtaatggtgagctgaaggggggtacaactggtccatcattatactacgaaaaataatctctcttgatataggtaagggcatcaaacgatgccctttatttatagaattatttatcacttttgtgcaaaatttgattaatcaatttctgagtgagagaaacataactttgctttttattataatagcgatagctgaaattgagcagataatagagctgataaataagttttctttctaagtaaccttcttccagtggatatatttcattatagcgttgataaaaattagttgggaaaggctcaaaaagtgatgaaaaagcaatatcgcattctctatctccccaatagcaagcaggattgcagacaaaaattttatcatctacttgaatacagttttcaatccataaattgccatgcagtatagagggttttgggttatgtttgctcaaagtatctgcaacaatttgcacaataagatctatatttccaaatatcaaacctttttctttacatatttgcaattgccagccaatacgattttcgctgaaaaatttagcccaacttgtctgccaatcatttggttgataaataggacctaaccaagtatcaaaatctaatccatatttatctggtccttgtatttgatgtagctgtgctattttttcagcgaatattgtaaatgaagactgtttattctttgacttatttaacgcttctaacagcaaaaaactatgcccttgtgaattgccaattccataaactaaagggacattaattgaattagttttagctaaaagagctaactggtctgcttctgcacgaaacatagagcggtaggatctttcgtttattttaacaaaaacagtttgaacctcatcattaatcagccaaatttcattcatttcacctgaatataatttttctttatgtttaataaaatagtaggcaccaaattgttctgccagtacctgagaaatagatttccacatagctcctccgatatgattcaagttagcctgactagatgataatctgaataccggtaatattctgtgataaatatcaagttttaataaatatcttattaagtagtgaatttatgtaactcttatctatttatatctttactcatatgttatgtggattgaatatttcagcgaaatgataaggatataccaattagtctagttgttactaatacagtaaaatagatacgttttctaagagttttctgttaaaatgcaccgcacttttattgtacaaggtaggtataaataaaagtgcggtgctttcagcacttttttattttatgtttaactcaatttacaagtaacctttcgtatgggctaccactgtataaggattcacaatgccaattattactttacctgacggttcacaacgtcaattcgataatcccgtttctgtattggaagttgctcaatcaatcggttccggactcgctaaggctactattgccggtcgtgtgaacggcgagcgtcgagatgcctcagatatgattagtgaggatgccaatcttgaaattattactgcaaaagatgaagacggtttagagattatccgacactcaacggcacatttattagggcatgctatcaagcaacttttcccaaatgtgaagatggctatcggtccaactattgacaatggtttttattacgacattgatttggaccgctctttaacccaagaagatattgataccctagaaaaacgtatgctggagctggcaaaaacgaattatgacgtgataaaaaaacgtgtcagttggcaagaagcaagagatacttttgaaagtcgtgctgagccttacaaaatagctatcttagatgaaaatattgcaaaagacgaccaacctgcactttatcatcacgaagaatatattgatatgtgtcgtggtccgcacgtacccaatatgcgtttctgtcaccattttaaattaatgaaagtagccggtgcatattggcgtggaaatagtgataataaaatgctccaacgcatttatggtacggcttgggcagataaaaaacaattagccgattatttacatcgattagaagaagctgcaaaacgtgatcatcgtaaaatcggtaaggcgttggatttataccatatgcaagaggaagcacccggtatggtattttggcataatgacggttggacaatcttccgtgagctggaaacatttgtgcgtacaaagttaaaagaatacgattatcaagaagtaaaaggtccatttatgatggatcgtgtgctttgggaacgtacaggacactggcaaaattatgctgatttaatgtttactacacaatctgaaaatagagaatatgccattaagccaatgaattgtcctggacatgttcaaattttcaatcaaggcttgaaatcttatcgtgatttacctattcgtatggctgaatttggttcttgccatcgtaatgaaccatcaggatctttacatggattaatgcgtgtgcgtggttttacacaggatgatgcacatattttctgtaccgaagatcaaattgaatcggaagtaacgagctgtattaaaatggtttatgacatttatagtacgtttggctttaccgatatttttgtcaaactttctactcgtcctgaaaaacgcattggtgaagatgtcatgtgggatcgtgcagagcaaggcttggcaaatgcacttaaacacaatggtcttgaatatgaaattcaagagggggaaggggcattttatggaccgaaaattgaatttgcattaagagattgtttagatcgtgaatggcaatgcggtacaatccaattagattttgcgttacccggacgtctagatgctacctatgttgcagaagataatgcccgtcgtacacctgtcatgatacatcgtgctatcttaggttcaattgaacgttttatcggtattatcactgaagaatatgcaggttttttcccagcgtggttagcaccgattcaagctgttgtgatgaatattactgatagtcaagcggattatgtgcaaaaagtagttaagcaattttctgaagcgggattacgtgtaaaagcggatatacgcaatgaaaaagtcggtttcaaaattcgtgaacataccttacgtcgagtaccttatatgctagtttgcggcgataaagaaattgtggaaaacaagattgcagttcgtacccgtaaagggacggatttaggcacgtttagtgttgaagaatttgttgagattttaaaacaacaagtgagaaaacgtgagttaaccttgttaggtgaataatgataaaaaatataatcggcacttaaaggtgccgattttttatggaattgttcacttaatacagtaatgaatacaacaaacgacgaaatttatttgtaatcggatcgttattaccaatggcagctaaaatcgctaaaaattgttgcttagcctctccatttaacgcattaagatcttgttttaatatatcaaacagcaaatttaatgaagcctcattacgattggcttgatgcaattgtaatgctagttttaatgcaatttctgctgttggatttttagcaaaatcagcttgcaattgctgaatttcaggggtatcagtcgcttttattaaaagctcaatttgagcaactaaaccatgccagcgactatcacgatcttgtagcggaattttatctaaaatctcttgggcgggttcaatgcgttttatcgtaatataggtttcagcgtagagtagagcaatatcgctatttttcttatcagataattcccatgcttctttgagcaacggtagagcgtcattatattgttcttgttccaacaaatttaatgcctgattgaatttcatttcttcttccttcggtaaaattagagataaacgttgttgtaacataatttcatctaaagaaccttggaaagcatctaatacttgtgcttgattaaataaataagttgttggtaatgattgaatatgaaattgtgcagcaatcattttttctgtttcacaattcactttacctaataaaaattgtccttgatatttttctgcataacgagtcaaaagtgcggtaaattctaaagagattttgttacttggggtataaaaaattaaaacaagaggtgtttgtacagaactttgtaatacacttgttagattttgctcattaatatcaataatatatgacataaaatttcctacgtttatttaaaggtaaagtgggtaaattgtaacaaaccaatcatttttttggaaaatatttcttcgatttaagattttcttaatattttttaataatacaaaacagctgataaagaattcggtcaggatgctaaaatagatgtaacagaagtgcagaaattaataaaaaccttggtattgtttgatatgagactgatttaaaacgtcattataaattctccaaaatttaatcgctaaaatagaagatctttgctagaatccgtacgaaaaacacctttctaatgtttttcatttttgttattaattcatttggaaacacatataatggaaaatcaatcttttctacaaaaatacttcaagtttaacgaaaaaaagacgactacaaaaacagaaatcattgcgggaatcaccacattttttactatggtttatatcgtttttgtcaatccgtcgattttaggtgatgcaggaatggataaacaggttgtcttcgtaacgacttgtttaattgccggtttgggaacaattgcaatgggattatttagtaatttacctattgcacttgcaccagcgatgggattgaatgccttttttgcttacgtcgtggtaggaaaactagggtattcttgggaaattggtatggggacaattttctggggatcggtagggttacttttactaactgtctttcaaattcgctattggctaatggcatctattccgcttagtttgcgtgttggtattggtgccggaataggattttttattgctttaattggctttaaaaatatgggattggttgtacctaatccggtaacgttggtttcgcttggcgacttacacaattcgcaagtattaatgggcgttttgggattttttattattgtagtgttggctgcacgtaatatttattccggagtattagtttctattgttactattacggctttagcattgatttttgatgaaaatgtggtttttaacggcgttatttctatgcccccaagccttgatgctgtagtcggaaaagttgatgttttaggtgcattagataccgcacttttaggcattattttttctttcttattggtgaatttatttgattcatcaggaactttgcttggcgtaacggacaaagccggttttagtgatgcacaaggtcgttttcctaaaatgaagcaagcgttatatgtagatagtattagtgcggtaacgggttcttatatcggtacatcggcaatcagtacttatattgaaagtggtgctggagtttctgtcggcggtcgcacaggaatgaccgcagttgtagttggaattttatttttacttactattttcttctctccattggctggtatggtgccggcttatgcaacagcaggtgcattagtttatgtcggtattttaatggcatccagcttaattcgggttgaatgggatgatttaacggaagcaactccagcctttattactgcggcaatgatgccatttacttattcaattactgaaggtattgcgtttggttttatcagctattgtgtcatgaagacttgtaccggtcgttggaaagaaattaatgcaccggtttgggttgtatctttgctctttgttgctaaatttatttgggttggataaatccttaattattgaatagatctttttaaagcggacattagtccgctttcttgttgatttaactagaattccgggatttttatggaacataaattggaagatattatcgctatttttaatcaatgctttgagcaagaatataatacaaaattagttaaaggtggcgatgagccgctttatgttcctgccaataaagattgctcttataatgctatttatttcgcacgtggtttttatagtagtgctttacatgagattgcacactggcttgttgcgggaaaagagcggcgtaaattagaggattttggttattggtatgagcctgatgggcgttcaatggaaagacaacgtgaatttgaacgagtagaggtaaaaccccaagcattggaatggattttagcaactgcggctggatttcgttattttgcgagtagcgataatttaaacggtaatccgggagatacacaaccttttaaattagctgtttatgagcaagttaaaacttatgcacaaaaggggttaccgaaacgagcagaaactttgcgtaaagccttagcggaattttataaaacagaagaccgcattgatctaagtaaatttgacgtagcgaggatataaatgttagctctggaaattaaacaattgacaaaagaatataaaaatggggttaaagctttatccggtatcgatcttaaggtagaagagggcgatttttatgcgttgttgggacataacggtgcaggaaaatcaacaaccattggtatcatcagctctttaataaataaaaccagcggaacaataaaagtgtttggttatgatttggatcggcaattagctcaattaaaacggcatattggcttagtaccacaagaatttaactttaatcaatttgaaaaaattcaagacattctagtgaatcaagccggctattatggtattgagcgaaaagaagcacttaatagatctgaaatatggctaaaaaaattagatttatgggaaaagaaagatcaacaagctatgcgtttatcaggtggtatgaaacgtcgcttgatgattgctcgagcattaatgcacaatcctaaactattaattttagatgagcctaccgccggtgttgatattgaactgcgacgtgctatgtggacttttttaaaagaacttaatcaacaaggaacaacgattattttaaccacacattacttagaggaagctgaaaatttatgccgtcatattggcattattcagcaaggtaaactgattgttgatatgtcgataaaagccttattgtcacagttagagacagaaacctttattttagatttagcactttctagttcaacgccaaaggttgataattacaacgtcacaattattgatgagctaacaatggaagttgaagttaagcgtggacaaggactgaataatttatttattcaattaaatggtcaaggaattaatgtattgagtatgcggaataaagccaatcgcttagaggagctgttcatttctatggcgttaaataaaccaaaaatcacggagaaaatataatgttagcttggattgcgtttaaaacaattttaactaaagaaattcgtcgttttactcgtatttgggtacaaactttagtcccaccggtcattacaatgacactttattttattatttttggtcatttgattggagcaagaattggagaaatgaacggctttagctacatgcagtttattgtaccgggattaatcatgatgtctgcgttgactaattcttttgctaatgtggcgtcttcattttacagtaccaaatttgctaaaaatatagaagaattactcatttcacctacttcttctcatattattattttagggtatatggctggtggtatagccagaggtttgtgcgttggtattttagtaacaatcgttgctatgttttttgtggaaatgactgtctattcatggctaattattgtgttgacacttttaatgacaacagcaacctttgctttaggtggtttaattaatgctgtttttgcccgctcttttgatgatattagtattattccaactttcgttttaacgcctttaacttatcttggcggtgttttctattctatttctttgttacccgctttttggcaaaacatatctaaactgaatcctattgtttatatgattaatgggtttagatatggttttttgggggttagtgacgttggaattcattatactttcactgttctgacattatttattaccgcactttatggcttggtatactatctaattagtcgtggggtagggttaagaaattagccgtcagatcaatacaaataaaggcgaataatcaatactcgccttacttttatgaacctaagttttttcctttaataaacaaataaatttgcaattatttatatttgatctatttaggtagttttccttgattttctatttcatagcaaggttcataagcatcacctccaggtaatttcattctgtgctggttgatgaaatcttgcaataaattgtcgactttttccattaatacgggatcaccttttagcttgaattttcctaattctgcaattttatcttgagtatctggtttgatatttcccgctacaattcctgagaaaactcggcgtaaattagcagctaaatcaactttagattggtcaaaatgtaaagctaaatttgccatgttttcatgagttgggataaacggtttttgaaattcagcagtaatttctaatgaccagttgaaataatacgactcatttttttcataacgtgatttttggatgtcgtgcatagcattatttatatggcgagcaactgaaaccggatcatcaatgataattttatacaaagattgtgcttcagagcccaatgtatcactaataaattgatcaatagaagcaaagtaagccgcactttcttttggaccggttaagataagcggaagatgttgggcattattatttggattgagtttaatgcctaaaatataaaggaattcttcaaaagttccaggaccgccggggaaaataataatcccatgtcccatacgcacaaatgcttctagacgtttttcaatatcaggcataataataagttcgttcacaattggatttggaggctcggaagcaataatagatggttctgtaataccaataaaacgactttgtttatagcgttgatttgcatgaccaatggttgcacctttcatgggtgcttccattacacccgctccacagcccgtgataatattcaactcacgatgtccaagttctaaacctacagaacggcaatattgatactctatttggttaattgaatgccctccccagcaaacgactaaatttggttgctcaccgttaattagggccttagcattgcgtaaaatggcgaagacttggttagtgatatgtttactgtcttgaatatcacaagggttaatgcgttgatttaagacattaacaaataaaatatcacgcagcacagcgaataaatgatattgaatatttttaatcattttattatcaacaaaagcatttaccggtgggttatgcaactctaaagcaatgccacgttctcttgctaccaaattaatatcaaaatcggaatattgatttaacaacgcacggctgtcgtccgtaattgcacctgagtttaatacggctaatgaacaattgcgataaagttgataaagcttacttttagcttttttggttaattgttcaacttccatatgtgaaagttgatccatacttcctttaggattgacataatgtatgtttttcataaaagttcctttttattggcgagcaagacgttggttagttggaatggattcaaaatttgaacgaaatggattaatatccaatccgcctcgtcgagtgtaacgagcataaacgctgagtttttccggttgagcaaatttcatcagatcacaaaaaatacgctctacacattgttcatgaaattcgttgtgttgacggaaagaaacgagataacgcaagagtttttctctgtttatttgcttaccgatataatgaatttgtacagttccccaatccggttgattggtaattaaacaatttgatttcagtaaatgactgactaatttttcttcaacccattgttcattcgtacaattttccaataaattaggattaaattcataggattgtatttcaatatcctgtgcatcaatacattcaccttgtagagtagtaatggattgttgatcataatattgcaacgaatttaaccgcacttttacttgcccttttgcacattttgctaaatcttgttgcagaatttgttcaacctgttgtagattttcaaaccgactttgattaaaactattcaaataaagtttaaaactttttgattcaatcagattttcactttgataatcaatttcaacatctgcaatcgcaacttggggtaagccttttaaatttaaccaagaaatttcataagccgtccaaatatctgcaccaaaagtaaatggctgtttttcaataatatttaaatcgcctcgattaagtttgcgtggcaccgcttgtaataaagtgcggtcataagtagagatatattctgttttttttcctaattttaatgtttgtaaactttggtcatggtattgcataatttgtcctttttgttattgccaatgccaagataaattagaaactaagcggcaatgatcacatttaaaatgaaagaggttaaataacggtttatccaaaagccatttttgctgacaattgggacataggcgttgttgttcactttgcagatccgtaccgccaatgcgataaagataataaaaagtgggaataccggtatgtttttcaatttctttggttagataataaccatgtttagttaaatgactattgagatcgctgatttcatacagtgcctgttgttctaaaattgatccgttcatttgtaattgatcgcaagcctgccaattttcttgccatttaataatatccatactcaagtgcggtatgtttttgaattgtttatacaatggaataggtaataaatcatcaccgctgtgtagtggagaacaagattgcagataggtagtataaagcacttgccaagtagttwcttctcttggatacgttatatctgaatttaaatcatctgcaacaatttgaaaactatcaaaaataattccagcactttttgcttgttcgagggcattatttacttgtatgttattaaacataggtaacaaactttgctgttcgggacaagttactcgcaacgcaaaacccttatcattattttgatctgccacaaacaatggaatttcacgtccaataatttgtccgttataacgccattgctcaataatttgattaatcaggtaagcaatattattaattggcgatttttgaggttgtcgataggtaaaaaatacttcaactagatacatacttatcgtttgataattattcggaggagtagattaacataattaatttgcatagaataccgctttttattttggaatataacgaatgaacgttgaaattaaaccgcacttacaagcgttacaaaaaattatgcaagacttaggattatggcaaacctgtcctcccgatgaacaagcttttttaagcactgtaccgttttttgtggatactatgagtgctaatgaatggttacagtgggtttttattcctcgtatgtatgcattgctggagagtcaacaatctttaccgtataaaatggcaattacaccttatatcgaagaagcattaaaagatcttgatggattaaatgacctactacagcctattcatgaaattgagaaattatgtcagagccaatagaattggatattttatatcaagatgagtttctcgttgtagtgaataaacctgccggaatgttggttcaccgcagttggctagatcgtcatgaaactcaatttgtcatgcaaactttacgagatcaaattggtcaacatgtttttcctattcatcgtttagatcgtccgacatcaggcgttttactttttgccttaaatgccggaattgctaatttattatgttcacaatttgaattaaaacaagtgaaaaaaagctatttggcgatagttcgtggttatttgagcgattctcaacgaattgattatccgcttaaagtgcaactggacaaaattgcagataaatttagtcgaaaagaagaactgcaagatgcaataacggattattatggtttaaaaaccgttgaaatgccttatggcgtagggcgttatagctcttcccgctattcacttgtacgtttaatgccgcatacgggacgtaagcatcaattacgtcgccatttaaagcatatttttcatcctattttgggtgatactcaatatggtgatttacatcaaaatcgggctttcagtcaaaatcttggtgtaagcaggttaatgttacatgctgaaaaactttgttttcaacatccggtaactaatgaaacaatagaaattgttgctgatttagatgagcaatggaaattgttattcaaaatatttaattggtaaatagctcagaacatttgaggaagtatatgttaaataatgtaaaattaactcatgaagaacagcaaagtgcggtagaaaaaattcaagaattaatgcgacaaggtatgagtagtggggaggctatagccttagttgcgaaagtgttacgtgaaaaaaagttacaccctgaatcaaaatataataaaattttgtgatctctgtcggatttttgaatattatttattgcaaatatagttaatttcgttgagtatttagttaaattttaggaaggtggtaaggctcacagtcttattatgaagtatagaggtctgtaaaggcttaaaaccaaagaggttaaaatattatggaagtaggtattgttaagtggtttaataatgcaaaaggatttggattcctgtctgttgaaagtagtgatgttgatgtttttgcacattattcagtcattgaaatggaagggtatcgctctttaaaggcgggacagaaagtacaatgtgaagtcgtgcatggagataaaggttctcatgccacaaaaattatccccatggttgaataataaaatcaaagctttttgtttcggtgtattgagcaaggttttaaccttgcttttttatgtgataaaactcgctattttagcagatctttaagaccttctttcataacggaaacttgattttcatataagaccttgctttctctttcatcaatcatataagaaatagtttccgataaagtcattttcattttacgtgaataacgagataatcgaagccagaccgcatattctagatcaattgattttttctttgtagattgtttctcgccattgaaaaaacgttttcttcttgctcttatagcttgatccaacttaataactaaatttgatgacaaatgattttctatccaatcttcaattttttcagggtagttttggtgtgtcattaattgccgaacaatgtcttcttgtaaactttgttctgtataacgtgtaatattttcaccctcgcgtgattttttgatcaaatagagccatttccaatttgcttcttgatttgtcagcttctgatatttcattttgtttactcatctgtgacattgtaacctatgtaataatatacgctttttatattattttctagtaaattttaatcaagaatacagaagtgaattaaatagaaatatgcgataatatgaccttaatcgtttaatttgatagagagtacatgtgacaattgagcaaaaaataaaaaaaagagccgacgaatgcttgtcagaacagttaatttcttggcaaaatttattacccatgttacaacttgataatgattttttagacgcttcattatctgagattgatttttttactttgcaaccaagagctaaaagtgcggttgatcttttcctaaaaaatcctcaacgatcattgcttgttttaaaagcagatgatcaagctgaatatgcaactttactacaagaatatatagaacaaaaacttcctgtttctgaaacaattagtggtgttcagtatattattgaacagggagacagtttttcttttccacaaatcagtctagcacaggcagcatcaatggaagacaactttgcaggaaaacaaaaagtggcaagtgctttatttttcgatcaaagtcagttattcggatcagttgtaattcaccccagttctcatgatattcaacttaattcaggattagtacatcaagtaaataatggtgtattgattttgagtgccggtgcattgttggagcaatttgagatatggcatcgtttaaaacacttattactaacaggtattttcagttggtattctcttaatcctttgcaaacattaccttgcacaattcctaattatcccttaaatctaaaagttatcattttaggtaatcgttcagagttggcaactctaggtgaattggaggaggaactgtatcatttcgcagattatgcagaaattgaaagttatttttcgcttaatgatgtacaggctcatcaaaagtgggcaagttatgttcatacgttggcaaaaaaacaaggaattgagctgagtattgaaggaataaatgcactttatcaactttttgtgagagaaagtgaagatcgttacttaattagtatctcaccattaaaattaaaagggatcttatttgaaacacaaattttaagtcaaagaaaacatttaagtgcggtagattttcaattattttttcaacaaaaagaacaacagtactgtttcttgcgtgagcaggcgtataaagacattttacaggagcaaatttttattgctacagatggggaaataataggacaaattaacggattatcagtcattgaatatcccggtacaccggtttcttttggcgagccttcaagaataagttgcattgttcaatttggtgatggtgaagtaattgatattgaaagaaaaagtgatctggcagggaatatccatggcaaaagcattatgattgcagaaacttgtcttgccggcattttagatcttccttctcaattacctttttcagcctcaattgcatttgagcaatcttatggtgatattgatggtgatagtgcgtctttggctgttttctgctcgttattaagtgcgttggctgatttaccgttaccacaaaatattgccgtaacaggtagtattgatcaatttggtttagtgcatgctgttggtggtgttaacgataaaattgaaggcttttttgaagtttgtcagcgtcgtagattaacgggaaagcaaggtgtaattattccaagtgcggtattaaatcaactcagtttatccagtaaagtaatcgaagctgttcaacaagaaaaattctttatttgggcagttgacgatatttttcagactactgaaatcctatttaagcgatatttagtaagcgaacaggatgctggattggaaaaaaatcttcccctcgtagatgtgattcgacaacgattagaagagagatctgaacaacagcataaaggtcgtttttggaactttttctttaatcgccattaaatgttaagaaacacgtgattttttaacaggttagtattattattaggggaattttcgtttaaacattggatttttaattatttagaggacaggtatgtataacctacaagaaattactgaaaaagctcggaaagcaattgatgcactgcaagataagagcattgaaagcttggaggcaattcgtgtggaatattttggtaaaaagggacattttacacaattaatgcaagggttacgtgatgtgtcggcagaggaaagaccggcagttggtgcaaaaattaatgaagcgaaacagaaggttcaagcgatattaaatgcaaaaaaagtggaatgggaagaaatagcgttaaatgaaagattagcccaagaacgaattgatgttagtttgccaggaagaaaaatggaactgggagggttacatcctgtttcaattactattaaccgtgttgtacagtttttttcaaaactaggatttactgttgagataggtcctgagattgaaacggattattacaattttgatgcgttaaatattcctaaacatcatcccgccagagctgatcatgatacattttggtttgatgcagaacgtttgttacgtactcaaacttcaggagtacaaattcgtactatggaaaaaatgtgtcctccaattcgtattatggcaccgggcaaagtatatcgtaatgattatgatcaaacgcatacgccaatgtttcaccaaattgaattattgtatgttgataaaaaagctaattttactgaattaaaagggttgttgcatgatttcttgcgagctttctttgaagaagatttacaagtgcggtttcgtccatcttattttccatttacagaaccttcggcagaagtggatgtaatgggaaaaaatggtaaatggcttgaggtgttgggttgtggtatggttcacccgaatgtgttgcgtaatgtaggtattgatccaaatgagtattcagggtttgcagtcggtatgggagtagaacgtttaaccatgttacgctacaacgtcacagatttacgttcattttttgaaaatgacttacgttttttaaaacaatttaaataataagggcaaaaaatatgaaaaaattaatatcggtcgtgttggttatgttttcccctcttacattcgctttttcagagggacaagttaaattgcctgtgcaggaaaaacaaccggcagcaatcattcgtgtatttgataattcggttaaaccctataaaatcattgaaggaaagaaactatctcgtagcaaaccacgtcatctttgtttatatatacttaatgtcgatcttcaggaaagaaatcttttagctcaatatgtacaagctcctgcaccgataaaggtaaatgtgccgaatgttaatgctaaagtacgcatggaagataaccagaagaattttttgattatgtttgacatgatgaaaaaagatattagagataatacacctactctatgttgggcacttggtaaagatgaccctatcggcatttacaaattggatgtgcaatttaataatgttgtgtttgaaaacttagaatttgaattattaaaatagagagagaattataaatgaagtttagtgaacaatgggtgcgtgaatgggtaaatcctgcaataagtactgaacagttatgtgaacaaattacaatgttgggcttagaagtagatgatatagcaaaagtcgcagcagatttttcaggggttgtcgttggtgaagttgtagagtgtgctaaacatccggatgcagacaaattacgggtaaccaaagttaatattggtggcgagcgtttattagatatagtatgtggggcaccgaattgtcgcaaaggattgaaagtcgcttgtgcaatagatggggctatattacctggtaattttaaaattaaaaaaactaaattacgtggtcagccatcggaaggaatgttatgctcctttaacgagctaggtattaatgaggattccagcggtattattgaattaccgcaaaatgcaccgataggtgttaatttacgtgaatatttaactctgaatgataacaatattgaaattagtctaacaccaaatcgtgctgattgtttaagtatagccggaattgctcgtgaaattggtgtagtcaataaacttgaactaaactcaccgcactttgaaccggtcaaagcaagtattaaagataaagtcactattgaagtattagcacctgaggcttgcccacgttatcttttacgtgtggtgaaaaatattaatgttaaagtcgacacaccgatgtggttacaagaaaaattgcgtcgttgcggtattcgttcaatcgatcccgtggtggatataactaactatattttgttagaacttgggcaaccaatgcacgcatttgacatggcaaaagtgactcaacctgtacaggttcgtatggcaaagcagggggaggaattggttctattggacggttcaacagcaaaattgaaagaaaatacgctgataatcgcagatcaagaggggccgttagccatggcaggcatctttggcggacaggcaagtagtgttaatgcagaaactaaagatgttatgttagaagcggcattttttgcaccattggctattgcaggacgtgcaagacaatacgggttacatacggattcttcgcatcgttttgaacgtggtgtggattttgaattggcacataaagcaatggaaagagcaaccgcacttttaattcaaatttgtggcggtgatgccggtgaaatttgtgaggctttaagtgaagcacatttaccaaaagtaaaacaaattcagctacgtcgtacgaaattagatacgttacttggccatcatattgaaacagaaaccgttactgatatattccaacgtttaggatttgcagtggaatatgcgaatgatgtctggacggttacttctgcaagctggcgttttgatattgaaattgaagaagatttaattgaagaggttgcccgtatttatggttacaatgtgattccaaataatgcacctttagcacatctacaaatgaaggaattactagagaaattattagatctcaatcgtatccgtaccgcacttgtggacagcgactatcaagagattatttcttatagctttgttgatcctgacgtacaaaaattgttacacccagaactagatgcacttgtattgccaaatccgatttcaaaagaaatgtcgacaatgcgattatcgttattgccgggcttgctgagtgcggttgtatataaccaaaatcggcaacaaaatcgaattcgtttgtttgaggcaggattacgttttgttcctgatactacagcagaatgcggtattcgccaagaatatgtgattgggggcgtgattgttggtgataaacgtcctgttcattgggaacaaaaaggtgaacatgttgatttctttgatttaaaaggtgatttagaacatattttgtctttaactcacgttggacatcgtttgcgtttcgtggctaaatcttatccggcactacatcccggacaatcggcagaaattttacttgataacaaagaaattggttttatcggtacagttcatccaaaaattgtacaaaaattggatttgtccggaaaaccgattgtattccaaattgaatggaatgcgatttctgagcgtaatgtccctactgcacaagaaatttctcgcttcccagccaataaacgtgatcttgccattgttgtagacgctgacgttgtggctggagaagtactggaagtttgtcgtgctgttggaggtaaacaactcattaatgtaaatttatttgatgtttatcagggggtaaatctacctgccgataagaaaagtttagcacttagcttaatgattcaagatacagagaagacccttgaagaaaaagatattaatgcggtaatatctgttgtattatctgcgttgcaacaaaattttaatgcttacttgagagattgattatggcactgactaaaattgaacttaaaaatagcttgattgaacagggtttaaataaattagaggcgaagaaagtagtagagggcttctttgaacaaattcgagtttcattagaaaatggtgaagatgttaagttatccggatttggtaattttgaattaagagataagtcatctcgcccggggcgtaatcctaaaacaggagaagctattcctgtttctgctcgtcgtgtcgttgtattcagaccgggacagaaattacgttcaagagtagaaaaaaccaaacctaaaaattagggattttttgtttctttaagaaaagccgtttacattaagtaaatggcttttatattttaacgtactagaaaaggtgtaatggacaaaatagttgctaaaaagtgcggtcagtattttatttttttacaccgcactttcttaccttaatttacctctttgaaactaatcatttcgccttgaataaaatctattttttcatcgttttcttgaacgaggggagtaggtgagaacgcttctttatcaaaggcaatatcaccctctattccttccggaatctttccatgtcggatacgtttaaaatcaaataagttagaatcacataaatgtgaaggcacaatattttgtatcgcactaaacatagtttcaatgcgtccgggatattgacgatcccatttttgcaacatttctttgacaacttgacgttgtagatttggttgagaaccacataaattacaaggaataattggaaattgtttggcaactgcatatttttcaatatctttttctttacagtaagccaaaggacgaataacaatctgtttgccatcatcactgatcagttttggcggcatagattttaatttgcccccataaaacatattcaaaaacaaagtttccagcatatcatcacgatgatgtcctaaagcaattttagttgcccccaattctgttgcggtgcggtataaaattcctcgacgtaaacgagaacagagagaacaagtggtttttccctcaggaattttttcttttacaataccatatgtattttctgccacaattttgtaatctacactaatgctttttaaatattcgggcaaaatatgttcaggaaagccaggttgtttttgatccaaattcactgccacaatatcaaaatgaataggtgcattgaggcgtaaatttaataaaatatctaacaaagtatagctgtctttaccaccggataggcaaaccatcactttgtctccattttcaatcatattaaagtcagcaatagcgttgcctacattgcgacgtaatcgcttttgtaatttattcaagttataactttgttttttatctttttcggtaatgatatttaaattcatacagtttctgatcttgttaagaatgcgatatagtaaaggggaattgccactttgccaacagaaaactgtgtttttaatgatctattatttaaattaagtacgagataaaagtgcggtagtttttagtcatatgtctattagaacaagcaaaattacgctataatcttgcaaaattttgcgtaaattattgcattgtgagaattgttaatgctcgaaacatcacaaactattcctgaattagtcaactggacgagagaacgagagttttctttgagtctatctacagaacgcttggcgtttttgctggctattgctatttacaataatgaaagacttgacggtgaaatgttggaaactgatctcattgatatttttcgccatatttcaaacacgtttgaacaatccgctgaaactgttagtacaagagcgaataactccatcaatgaattagtgaaacaacgttttttaaatcgctttagtagtgagtttactgaagggttatctatttatcgcttaactcctttaggtgtaggggtatccgattactatattcgccagcgagaattttccgctttacgtttatctgttcagctttctattgtagcagatgaaattcaacgagcttcagaatctgcggaagaaggcggtgatgaacattattggcgtaaaaatgtatttgcaccattgaaatattctgtagcggaaatctttgatagcattgatttatctcaacgtatgatggatgaaaatcaacagcatatcaaagaggaaattgctgaactgcttactaaagattggcaaacggctattgccagttgtgaacgtttattagatgaaacctcgggaaatttacgtgaattgcaagatacgctcaatgctgccggcgataaattacagtctcaattgttacgtattcaagactgtgtaataggacatgacaatttgtattttgttgagcaacttattgtagatttacaagcgaaactcgaccgcattataagctgggggcaacaagctattgatttatggattggttacgatcgccatgtacataaatttatccgtacagccattgatttggataaaaatcgtgtcttttcacagcgtttacgtcagtctattcatcattattttgatcatccttggttcctttggatcgcacaggctgaacgcttaattgatctgagggaagaagaattaacattacgtgaagaagaagcccttggggaactgcctgaagaattgcaatatgaatcccttgctgatttacatgagcaaattgtggaaacaatgcaatctttattgattgaatatcgtctacaaaatacccctattgatttgagtgaggttttgaccgctcaactaaaacaatacccacttgctaaacattttgatatagctcgtattattattgatcaggccgttcgtttaggtttagctcaagatgatttaaacggtatttatcctaattggagatcgattaacgaaaatggtgcagaagtacaggctcatgtaattgataaatattaacccaatttaaccgcactttttgtaactgattaatttaacaactttctgaaaagaaaagagaaaaatatgacagacaatattcaagatttactttccattaaattagctagagctattgcaaatcctttattccctgaagtggatagccaattgcgttcaggtaagcacattggacaagagtatttagataattattcatttttggcagattttcaacatgaattagatagtttctaccggcgttataatgtggaattgattcgtgctccggaaggatttttctacttacgtccaaaagcaaccacgttaatcgctcgctcagtgttgagtgaattggaaatgttagttggaaaagtgctttgttacttgtatctcagtccggaacgtttggcacaacaagggatttttactgttcaagaagttcatgatgaattgatcaacttggctgatgaaactaagttattgaaagcaattaatttgcgtgcaggtggttctgatttggataaacaaaaattagcggaaaaagttcgttcagctatcagtcgtttacgccgtttaggtatgattcatgcggtaggcgatcaacatagcggtaaatttacgatttctgaatctgtgtttcgtttcggtgcagaagttcgttcaggggacgatccgcttgaggctcaattacgtttaattcgagaaggggaagcagcaacggctcaatcattacaagaagaaaaaaatggcttgaaagataatatggatcaaagtgcggtagaaaatgaacaagattttgaaaatgaagaaaatgaggggattgcataatggcagatttagcgttacagccgaccatgtctgaagaaaacattgatcaagttgaactacaggataaacaagaacccctcgaaaattttacggcattttcgccttttcgttctcaggggggagtagcgcgaggtaagtttcgttctttaaccttaattaactggaacggtttttttgcccgcacttttgatttagatgaattagtaactacgctttcaggcggtaatggtgcaggtaaatctacaacgatggcaggatttgtaactgcacttattccggatttaactttattgcatttccgtaacactactgaagccggtgcaacaagcggttctcgtgataaagggttacatggaaaacttcgccccggagtttgttatgcggttttggatactattaattcacgtcatcaaagaactttagtgggagcaagattacaacaagtggcaggccgtgataaaaaagtagatattaaaactttttctgttcaaggcttagcattatcacaaaatccaaccgcacttttcactcaaataattgatgagcgtcaagcgaggatattaaatcttaatgaattaaaagacaaagttgaaaaactcaatgctcaattcaaacaatatcattcaataacagattatcatgcgatgatgtttgatttggggattatcccgaaacgtctgcgttcttcttcagatcgcagtaagttctacaaattaattgaagcatctttgtacgggggtatttcaagtgccattacccgatcattgcgtgattatttattgcctgaaaatttgggggttcgtaaggcttttcaggatatggaatcagctttacgtgaaaaccgtatgaccctagaagccattaagattactcaatctgatcgtgatttatttaagcatttaattactgaaacgactaattatgtagcatcggattatatgcgtaatgtcaatgagcgtttaggtaatattcaacgtgcgattaattttcgtcgagattggtataaagcaaaaggtgagcaatatttatcacaacatcgcttagtggaattgagtaaagaagctgctgatttggctgaaaatgagaaaatcttagaaatagatcatcaaagtgcggtagatcatttgaatttagttctaaatgctttacgtcatcaggaaaaaattgaacgttatcaacaagatgtgcttgaaatcacagaacgtttagatgagcaaactttagtcgtggaaaatgcgaatgagcaggtaattgacactgaagtacagttacagaatgtagaaagtgaattggatcagattcgtaatcaattagcggattataagcaagccttagatgcacaacaaactcgttatttacaatatcaacaagccatacaagcattagaaaaagctaaacatttatgtggattacctgatttagccgttaaaaatattgacgattatcaccaagagtttgcggttcaagctgatcaattaactgagaatgtactggatcttgagcaaaaaatgtctttgacgcaagttgcaaaaacacaatttgataaagcttatcaattggtatgtaaaattgccggcgaagtacctcgttcagcagcatttgagcaagctaaggaattgttgagagagtatccgacacaaaaaatacaagctcaacaagtctctcaattaagtgctaaattacatgagcttgagcaacgttatcaacagcaacaaagtgcggtacgtttattaaaagaactgaatcagcgtgcggatttacaggtcgatgaagcagaacagttggaagattattatgtagaacaagaagcattgattgaagatttaaccgacaaattatcagagcaaatagaaaaccgctctgtcttgcgtcaaaaaagggatcaactaaccgcacttcatcaagaaaatagccaaaaagcaccggcatggctaacagcgcaagccgcattggagcgtttacaagaacaaagtggcgaacattttgcagatagtcaagatgtcatgaatttcatgcaagcacagttgattaaagaacgcaacttgacgattgaacgtgatcaacttgagcaaaaacgtcaaaaattagaaatacaaatttctcgtttaagtcagccagacggctcagaggatgctcgtttaaatatgctggcggaacgtttcgggggtgtgctgttatctgaattatatgatgatgtacctattgaagatgcaccttatttttctgcgttatatggaccggctcgccacgccattgtagtacgagatataagtgcggtgaaatctcagctggataatttggaagattgccctgaagacttgtatttaattgaaggcgatccaaccgcatttgatgacaatgtattggattcaaaagaattggctcatggggtagttgtacagatttcagatcgtgagttacgctattcgaaattccctgaagttcctttatttggtcgagcggctcgagaaaaacgtttagaagaattaaatattgaacgtgatgaaatttcggaactttatgcacaaagagcttttgatgtacaaaaatgtcaacgtttgcatcagcattttagccagtttgtcgggttgcatttggctttagcatttttacctaatccggaacaaactattgctgaaattaatcagcaacgcaatgaagtagatcgtgaattaaatctacttaacagtacagaacaacaattgcgtcttcaattggatcaagccaaagaaaagtggcaattacttaacaaattaagaccgcactttgctctattggctgaggaaagtttaatagatcgtattgaagaatgtcgtgagcaactggattttgcacaacaagatgagttgtttattcgtcagcatggtgcgaatttatcgcaacttgaacctattgtaagtagtttacaaagcgatcctgaacattatgatcgtttaaaagttgattatgaccaagcagttattttgcaaaaaaaagtacagcaatgtttgtttgctttatctgatgtaatgcagcgtaaagctcattttgcctatcaaaatgaagttcaaaccgaaacttctgatttgaatgagaaacttcgtcaacgtttagagcaaacgcaacaacagcgtaatgatttccgtgaaaaattacgtcaaaagcaagaacaatttgcccaatataataaagttttaattgagctgacatcttctttgcataataaacaacaagtactaaatgagttgttacaagaagtaggtgatcttggtgttagagtagttcaaggggcagagcagttggctcaatctcgtcgagatgagttatatcaacaactttctatcactcgccaacgtcgcactcatgtcgagaaagaattaactcgaattgaaagcgaatcgcaaagcttgaatacccgtattcgcaaagcggaacgagaatataaggctcagcgtgaaacagtagtagcggcgaaaattagttggtgtgtggtgatgcgattatctcgtggcagtgatgtcgaaaaacgtctaaatcgccgtgagtttgcttatttatctgccaatgaattgcgttctatgtcagataaagcccttggtgcattacgtcaagctgtagcggataatgaatatttgcgtgattcattgcgaatttcagaagatagtcgcaaacctgaaaataaagtgcggttctttattgcagtttatcaacatttgcgtgaacgtattcgccaagatattcttaaaacggacgatcctattgatgccattgagcaaatggaaattgaacttaaccgtttaactaacgaactgactcaacgagaacaaaaattagcgattagttcagaaagtgtggcaaatattatgcgtaagacaattcaacgtgaacaaaatcgtattcgtatgctaaatcaaggtctgcaaaatattgcttttggacaagtcaaatctgtgcgtttagtagtgaatattcgtgattctcatgctatgttgctcaatgccttatctaatgaacaaagtgaatatcaagaactttttacggacagtcgcataaccttctctgaggctattgctaagttatatcaacgccttaatcctcatattgatataggacaacgtacagcacaaactatcggtgaagaacttttagattatcgcaattaccttgatttagaagtagaagtctatcgtggtgcggatggctggttacgtgcagaaagcggtgctttatctaccggtgaagctattggtacaggtatgtcaattctcttaatggttgttcaaagctgggaagaagaaagtcgccgtattcgaggaaaagatattattccttgccgtttgttattcctagatgaagcagcacgtttagatggtaaatccatctcaacgttatttgaattgtgtgagcgtttagatatgcaacttctcattgcagcacctgaaaatattagtccggaaaaaggcacaacttacaaattggtgcgtaaaatttcaggcaatcaagaacatgttcatgttgtcggattgcgtggatttggtgcaacagagtagtcaaataaaagaaagtgcggttaaaaataagtaatttttgactgcacttttttgaggaaaataatatatgttggttttcaaaaaagaaaaaaaagaaaagctatctcttttagaggagataccttttaaattggaaaaggacattcaacgtctttttgaacaaaatctatcagaaatcacatcttatgatttggtcaaatccgaattttcaattaaaaattatcgcattgatacattagcttttgacgaggaaagtaattttttgttattattgaatataaaagaaatcaaaatattagtcttgttgatcagggaatttcttatcttaatttaatgcttgataataaaggtgagtttattcttgaatataatgaaaaaaatgaaacaaaatcattaaaaagaaatgaagtagattggtctcagtcaaaaattatttttgtgtccccatcatttactgatttccaaattcaagctacgaattttaaggatttgcctattgagttatgggaaataaatcaattcaatcaagatattataactatcaaacagattaaaaaatccaaatctgcacctagcgtaaaacagattaaggttacccaagattcatctttagataaattaacgaaagagattaagatttatacagaacaagaacatcttgaaaatcaatctgatgaaataaaagaactctacgatgaatttaagcaagctattttgaaattagatagtgaaatagaaatagttgccaaaaaagtttatatcgcatttaaaaagaaatctaatattgttgatattcaaattcagaagaaaaatttaaaactatggatcaatttatctaaaggaaaactagatgatcctaaaaaactagcagttgaagttgataaaaaagggcatcatggtaatggagattatgaattaaccattaaaaatactgataatattgaatatattatgagtttagttaaacaagctgtttaggagaaataatgcaatatcttattcttgccgttttatgtagtgtttctgtttccattttatttaaattcaccaaaaaatatcaaattgtaaccgcacaaatgatcgcttttggttatgtggttgccttgtcattgagctattttttattagcacctaattttaaaggacttacttttaccgaattttttgcacaaagtgaagctaagccgatctttatcagtttagggattttattgcctgtcggttttttagtgatgtcgaaagcagtggagtatggcggtattattcgcacagatgctgcacaacgtttggcattgttcttgcaaattatcgctgcagttgtgattttcggtgaaaccttaagcgatatgcgaattgtcggtatcattgtcgcatttttcgctttatttttcctattaagcaaacctgccggagggataaaaagtgcggtcaaagccgcttttgctcttgccggcgtttggttaatttggggagcaacagggattttatttaagaaaattgcactaatgggcggtgcatttcctacaaccttgtttatcacttttgtcctagccggtgtgattatgtttatctacctattaatcaaacgcactaattggacagtatccagcctgattggtggcattattttaggttgtttgaatttcggtaatatcctgttttatatctacgcacatcaacatttcaaagaaaatccaaccattgtttttgccacaatggatctcggcgtaatctgtcttggtacactagtcggtgcaactatatttaaagaaaaaatcagcaaattcaatggtattgggatcttattaggtcttgtcgctattttgttgttacgggtttaggggaagattaaatgacaatcagcattcaacaacgttctgaactccatcgccaaatttggcaaattgcaaacgaagttcgtggagccgtagatggttgggattttaaacaatatgtattaggcacactgttttaccgctttatcagtgaaaattttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgaaaatggtacagatttaaatgaccttctacctaaaatgagcccgcttaacccacaatataaaatgaaaaaacagacggtgtttgagaagatttccgcctttgtggaaaaatttaaggggattgggggaatgttttaatgaattctacaaagtgcggtaagttttttaaggtttttgtgtatgcaaaatgatttcagtttttttatctacgattacgaaagttttgggattaatcctgccactgacagaccggctcaattcgccggtattcgtacagatcaagattttaatattattggcgagcctgtaatgttttattgtaagcaaaccgatgattatttaccgtcgccggaatcagttttggtaaccggtattacaccgcaaatttgtaatgagaaaggtattcccgaaccggaattcgcagagaaaattttagctgaatttagtcaacccaacacttgtattatggggtataacaatgtccgttatgacgatgagatgacacgttataccttttatcgtaactttattgatccctatgaatacagttggaaaaacggcaattctcgctgggatttaatagatgtagtccgagcttgttacgctttacgtccggatggaataaattgggcttacgatgatgatggaatgccgagttttcgtttggaaaaattaacacaagtaaatgatatagagcatggtaatgctcacgatgcaatggctgacgtctatgccacgattgcaatggcaaaattgattaaacaaaaacaaccaaaactttttcaatttttctttgaaaatagaggaaagagggaagttgagaagttgattgatatcgctaatatgaaacctttagtacatgtatcaggcatgttgggtaattatcgaggtaataccagctgggttgtgccattagcttggcatcctataaatcagaatgctgttattgtttgtgatttagcaaaggatattgatgacttattggctaaaagtgcggtcgaattacgtcaaaatttgtatacaccaaaagttgaattggaacaacataatattttacctgtaccacttaaattagtgcatattaataaatgtcctattcttgctcctgcaaaaacattattgccggaaaatgcaaccaaattgggaattgatcgagaattctgtttgcaaaatttgcaaaaactgcgtcaatctccagatattcgagataaggtcattgaaattttccatgatgaaagagaagtaatacacagtgataatgtagaaactgagttatacaatcagtttttcagtaataatgataaaaacaatatgacgattttgcgtcaattatctccggagaaattaaacgagcataatttatctttttcagataaacgtatcccggatttattatttcattatcgagcaagacatttctataaaacgcttgatcgctctgaacagataaaatggcaaaaatatcgccaacgtaaactggaaaaaagtgcggttcaatttgaggaaagtttacaacgtctagtagaagagtatcaaaataatcctgaaaaattattgttgttacaacaagtatatgaatatggagcaactttacttcgtaagttatattgataatagcaatatctagaaatgcaggatgaaaaggtatttggtaaataaaataaaagagacaacgtaacaactataattttatttactaaaatttatagaggagaagagggttgaatattttaattgattttgatggtacttgtgtaacgcataattttcctgaaataggcgaagatattggtgctgcacaagtattaagagatttggttaagaatggtcataacttgattttattcacaatgagatcggaagattgttatcttaatgatgcgttggcatggttcaaaaataatgggattgatttatacgctgttaatatcaatcctgaacaatctaagtttaccagttctcctaaagcctatggagatcttattattgatgatattgcattaggcattccgaaatggtcctgccatttttatcgcccttgtgttgattggaaattggtatcggaaatgctgtatagtcaaaaattgctaacatttgaacaaatcaataaatatgattttagcatgagaaattatttataattatgaaacgttttaaaagcaacgttcacagctatgcgaggacgttgctttttttgtagcttttatttattaagctttttctccttaagaccacactacaaaactattacaaatcatatctctatttaataaagttaaataatgatacctttcaatgtacaagggagtctttatctgtcttgcttagctggtataactggcttgtgcataactttgtgatttaattawwacgtagttttcactaaccgcataactaatttcatataatgtatattatgttaaattaaatgattagatatgtaacttttggactggtttgcccccctattttgctatgaaatcttctgttaattagatgagattaaaaaaataaaaacgataaaaataaaagcgagttttttatttttttatgtttgatacagtgtcactaaattnnnnnnnnnnnncattaaaaaagccccatgattttcatcatgaggcttaaaattttgaaaactttacttatacacgtttaaaatcaatatggactaattttggcttgaatggatggcgttgcatcgcttgtactttaacagaaatttccttcccttcaataactaggataatagtatccgaatagaaagaatcatgaatttgagcgttatttaattcatcatgatttaatacaattgaaacaggtgcttcactaccaccataaacgatagcagggatttgaccattatgacgcaggcggcggctcgcacccttaccttgcttagaacgaacttcagcgttaaatttaaatgacattttttatgttctcttgaataaaataaaaaaacaaaaaaaccgcaggcgacccagcgatttcccttacgttatgctaaaacttatagtctcgttttagacatggtgctgattataatgagttattctctataaatcaaataaaacattgaatttaaactggatatttctactaaaaaagctaaaatagccgtcatactttcttattataaatggrtagttcatggacttattaattaatttttttactgattatgggtattttgcagttttctttgttctcattatctgtggctttggagttcctattccggaggatattactttggtttcagggggggttattgcaggtttataccctaatgaagttaatgttcatatcatgctgattgtgagtatgcttggtgtgttaattggtgacagtacaatgtattggcttggtcgcatttatggtgtgaaaatattaagaacccgtttaatcaaaaaaatagtaacccttaaacgtttaaaaatggtgaaagaaaaatttgctaaatatggcaatagagttttatttgtggcacgttttttacctggtttaagggcaccaatttatatgatatcaggcattactcgtcgtgttagttttattcgttttctcctaattgacttttttgctgcaattatttcagtgcctatttgggtatatttgggtgattttggtgcaagcaatctagactggttacatcaacaaataaagaaaggtcaatttgcaatttatatcttaatacttctactcgcattgttcttattttggaaatggaaacgtagtaagaaaaaagatatgtaatttagaccatcttacagggcgtatttaattatgccctattttatttacggtatagtgattcgtaaaaaataaccatactcttctactttcgatacactagatatcgtataaaatattggggatatataatttaaaaagggtactataaaaagtaccctaatttatctttaaattaaagtgcagattttgctttctcaactaatgctgtaaaagcaactttatcaaacacagcaatatcagccaaaatcttacgatcgatctcaacagatgcttttttcaaaccgttgataaatttgctatacgataaaccgttttgacgagtagccgcattgatacgagcaatccatagttgacggaattgacgtttacgttgacggcggtcacggtaagcatattgaccagctttaattactgcttggaatgcaacacgataaacacgtgaacgtgcaccataataacctttagctgccttaagaactttcttatggcgtgctcttgcaataacaccacgtttaacacgagccattatctaatctcctattgtccatgaatcttaaaaaatttaactaatcgtatgattgtgcccaaaacgctatttatgcgtatggtaagcatgctaccactaaaacttggtctgctttcgcaaccattgatttatgacgtaaatgacgtttacgtttagttgtctttttagtcaaaatgtgacgtaagtgagattgtttacgtttgaaaccacctgaagcagttttcttgaaacgcttagcagcaccacgtaaggttttaattttaggcattgtttataactccgcattgtttaagtttaacatcagataattaggcgaataaaaatacggcaattcataccgcactttactacttgaatttgcactaattatttctttttgggggcaagtaccataatagcttggcgaccttctaatttgccaggtgcagattcaacaacagcaatatcagcaagatcatttttaacacgttctaacatgtctaaaccaatatcttggtgagccatttcacgtccgcgaaaacgaacagtgattttagctttatccccatcctctaaaaagcgaatcaggctgcgtagttttacctgatagtcgccttcgtctgtaccaggacggaatttaatttccttcacttgtacaactttctgctttttcttctgctcttttgcagctttacctttttcataaaggaacttaccgtagttcataatacggcataccggtggttctgcatttggactaatttcaacaaggtctaaatctgcttgctctgctatatttaaagcttgttggatagatacaatacctacttgttcgccatcttggtcaatcaaacgaacttctttcactctaatttcatcattaatacgattagggcgatttgttgccggagctttttttacggttttaataatgttattcctctaacgattttaaactaccatcaaactgcaatactgcagaagacataaacgattgctgtatttttagcaaaaaacggcgagattttataagattttcaattactatgcaaggtattaaggcatatattgacaagttttataaataaatgcacttaataaaatacatagaacgcatagaatttgaataagttttttctttgttagcttttctgccggcataactagtttcctttgcactttttaaatttaaaacttcttaattattttatttaatgttatcatttcttgagttagatcaagttttgcattacacgcttttatctcagtttcaatgcttttgaggaatgaatgaaaacttttccctatgaacaaaaaattggacgacgagttcaatctactggttgtgctattcactgtcaagcttgtagtattagtcaactatgtattccgtttatgtttaatgaacatgaattagatcagcttgataatattattgagcgtaaaaaacctattcaaaaatctcaaattttatttaaagcaggcgatgaactgacttctctctatgctattcgatccggctccattaaaagttatactattggtgaaactggagaagaacaaatcaccgcctttcatttacctggtgatttagtaggatttgatgcgattaatggtatgcgacattttagttttgcacaagctttagaaacatctatggtgtgtgaaattccttttgatattcttgatgatctatcaggaaaaatgccgaaattacgacaacaaataatgcgtttgatgagtcatgaaatcaaaacagatcaagaaatgattttgttattatctaaaatgagtgctgaagaacgtctagcagctttcatccataacctttcaaatcgatactctgctcgtggtttttctgcacgagaatttcgtctaacaatgacccgtagtgatataggtaattatttgggattaactgttgaaacaatcagtcgtttgctgggacgttttcaaaaaaacggtcttttatccgtgcaaggaaaatatattactattaataatatgtcagaactttctacacttgcaggaacgacaaaacctaaaattaaaatgatcggataaaaacttggactcaataataagttactactttcgatcattttttaaagtacaattacttgtcatttttataaatattgcctattctatttctatagtttgtttccactggaaaaatatgtttattgtttttgcaaaatatcggaggttattatgcaatttaataatatacttgtcgttttaaatcccgaatcagaaaagcaatatgctttggctcgagcagttcgtttggtacaagaacaaaagagcgagaatagagtaagaattacaacttttatgacggtgtatgatttttcttatgaaatgtcaactttgctttcttccaaagaaagagaaacaatgtgtaaaagcattattaagcaacatcagcaagctgttcaaccatatctcgaaaaatatgcggatccgaatattgaatttaattcaattgttctttggcacagtaatgaagcggaagctattacaaatgctgttgcggaacataattatgatcttgtcattaaatatactcaggagaaggaatctttatcggcattaatttttacacctcaagactggcaattactacgcaaatgtcctgcacctattatggtagtacgtgatggaaattggaaacatcaacgtcgaattttggtagcggttaatgtttccaataatcaagaggaatatacttcattaaataatgaacttgtttctttaggaattgatttagcggataaattagaacgaggtaatattcatcttgttaccgcttaccctcccactccaattaatatggcaattgatttacctgaatttacaacaacagaatatggtgatagtgttcgtggacagtatcttttaaatatgaaagcattacgccaacaattttgtatagatgaagaccatactcacgtaagagaaggatttcctgaagatgttattcctgctgtcgcaaaagagttggaggctgaattggttgttttgggaacagtaggaagaacaggactatctgccgcattcttaggaaatacagcagaacatgttattagcaaattagaatgtaacttgttggcaattaaaccgagtaaaaaataacaaaattattacacgaaaatcctaacttaatcgttaggatttttttaaagtaattttaaaaatgtgcctacggtatagaatgagccaaatactaaaataatatccttttcagtagcattttgtaccgcactttttactccctcatatacagaagaataagtttgagcagatagctcattagttgttgatatttgttgtaatgtcataaataattcatgactactctgccctcttacgccatctaaggttactaaattccactgatcaacaactttgattaaaggcgataatattccttgactatctttatcttttagaatgccacataccgaaataatttttccgattgatttagctttaagtgcggttaatctttctaataaataggaagctgcatgaggattatgaccaacatcaacaataatttgaggtaattgtttaactgtttttttacttaatttagctaaatttaataatttttctgggttgattttctgaaaacgccctgccagttcaacttctctaagtgacttatgaacaactgatatagaaatatcaaaaggtaaataagccaacgttgctaaagctgttgcagcatttgccaagggaatactacaaataggtaaattatccatataaatagctttatcaccttttattgtttcccatgtccagccattttcctgtttactgaatttccaatctttattacgacaaaataatattgaatctaattttttcccttgttctaataaagaacagggaatattgttttcaccaataacggcaggcttatttggacgaaaaatacccgatttttcaaaagcgatctcttctcgagtattgcccaagaaatccgtatgatcgatgtcaatactggtaattacggcaagatctgcatcaacaatattagtagcgtccaaacgaccgcctaaccctacttctaaaataacaacatccaaattagcttgcttaaagagatacaaagcagaaagtgtactaaactcaaaataagttaaagattgtgatttatgttgctcaataaaagcaaatgcttgagtatgttcttcatcagctaattcttgattttgaattcttactctctcgttataacgaattaaatgaggagaggaataaacaccaacacgaaatcctgagtttagtaataatatttccagtagacgacatgtcgtcccttttccatttgttcctcctacagtaataacaaaaggagcaggctgtaataaatctaattgttgtgcaactgttgtgaccctatctaatcctaagtcaattgctttagcatgtgctttttctaaaaaacaaagccactgttcaagtggcgatgttgcaaataaatttaaactagacatcatcagatttttcttgaattaattcaggttcaacaaaaggggaaggcatattcatgagcttgcttaaaagattagctaaagtttcacgcatctcagaacgtttaacaatcatatcaatagctccatgctccagtaaaaattcactgcgttgaaaaccctctggtaatttttcacgcacagtctgttcaataacacgaggtccggcaaatccaattaatgctttgggctctgcaatattaatatcacccaacattgcaaaacttgcagacacaccgcctaaagtcggatctgttaatactgaaataaaaggaacacctttttctttcatctttgccaatactgcactggttttagccatttgcattaatgagaacaaagcctcttgcatacgagctccgccacttgccgaaaaacaaactaatggacaatgtaattctattgctttttcagcagcttgaacaaattttgagcctacaacagatcccatagaccctcccataaaactaaaattcaaggcagccacaacaattggcatgccataaagagtggctgaaacagtaatcaacgcatctttttcgcctgtttctttttgggcggctgacagtctgtctttatatttttttaaatctctaaattttaaaatatctttaggttctaaatctgcagcaatttcaacaatgctatctttatccaataaagcaacaaggcgttctcttgcatcaatacgcatatgatgaccgcactttggacaaacttctaaatgacgttttaattcatcacgatacaacacttgctcacaggaagtgcatttggtccataccccttcaggcacatttgattttttgctatttgaagttgtatttttactaaaaattctatcaatccagctcatgtttaaccttttatttattaacttaaaactcgcctcattagaccataagtcgggggaattttccagaatttaacaactccgactagcctattaattcaagcaatttaactgccattaacgctagattaaagtgttgctcatcggctacagaccaaaattctattttattttccgccgcacttaatgtactaatatgcaatttcactttttcctcattgttttcattttctccgtgagtaaccggcgtaattaatttctctgcatgatattgaattagctcattttcttgccaaaaatgtaattggctttctatatcaaccaaataatctgaaagtgcggtcacaaactgccccattccataaaatacaggcacttgaatttgatgaaagacaatattctctaattgtgggtaaattttttgtaactgtataactaaattttgagtttgtacaggaaagacatcaaaggctaaacgttgctgttccgtatccagcggaatcccatttaataattgagctgtctgtccggccaatttggcaacttgttctgcttgtacataggaagcgggtaataatgaagtcacaaccaattgatgaatgctattaacaatattactgatagctaaagcacattgcgttacttgtggatttggaagggaaacaatatttctttggcgtaattcaatcaattgatcgtcattaatacctggtacaacaaccggaatatttgcaaggcttgcacaaatgcccagcacatcgatcacaatacaacctgaatcagctatttttgccaaaagatcaacatgctcaattgtccctgcaaataaaacataattaaactctgtccaatctgcatcttcaggcataatttgaataactgctttattgttaaaacgaatgccttgctcttctttgaaaggctttatttcaataattgtcaagctttcaatttcaagctgagtgtgttctaaagtttcgacaattttctcagataactcaaattctgctgcaatagcaatacttaacatttttctctcttataaactcggatagaatgcagtgcattttacaaaataattaagggaaaagaaaatgctcctgtaattatttactaggaatattgctcagaaaattaacgcaataaatcccaaacaggacgacaattttccggtaacactagagattttcccaattcaatccaattgcttggaaaatgaaaatcggaaccaacggaactgtataaatcgtactcttccgcccaatgagcaagtaataaacgttgatccttggtttgtccacaacctgctacttctattgcatccccaccccactgtttaaaatcagcgataagacgttttatcttttttgttgtcatagtatagcgtaatggatgagcaagcactgcaattccgttggcttgatgaataatctctattgcattagggatatcaacccattgtgttttgacatatgcagattttccttgtgctaagtattttttaaaagcttgactaatgttaataaccttgcctatttgcactaaataacgggcataatgtgctcttgttacttctccatccgtcagtttttgcgtttctgcaaaggcgttggctacacctaaatgctccaattttttaccgatttcaaccgctctttgtaaacgaatttttgcctgctcattcaaaagtgcggtcattttttttgaattttcatcaaaacctaatcctacaatatggatactataattttcccaagaagtagaaatttcaacaccattgatcagtgaaatgcctaattgttctgcctgagtacgagcttgcgataatcctgcaatagtatcatgatctgtcaaggctaaaacatttacaccttgttgatgtgcccttatcactatctcttgtggtgataaggtaccgtctgatatagaactatggcaatgcaaatcataaattttgttcatactttcctaaattacttatcaaaaataaaaagtgcgataaattttaccgcactttcacttagttatgtgtctgttttcgctattgaagggctttttctattttctcaaacaaatctttcgacaaattttccacttcgcttaagcgaactaaagcacgtttcatcaaagtttgccgttgaggatcaaaacgagagaaacgaattagcggttcaattaagcgtgaagcaacttgaggattactttcatttaaccttaacaggatctcagttaaaaaacgataacctgaaccatcgattgcatgaaatccttttaaattatgtacacaaaagctaccgactaaagctcttaaacggttaggattattaaaattaaaacttggatgctccattaattgttgcacatagtccaaagtattgtcttcaggtcttgtagcttgtaaggcaaaccatttatccataaccaaaccgtcttgttgccatttttgctcaaaatccgctaataattggtctcgacaaggtaattgagcctgtgttgccgattttaaagcatttaaactgtcagtcatgttatttgctttgacataatgtttattcaccaaattgttacctaaatctgtataagccaaataattcaaacagagattacgcaatgctctcaacgcaatatcttgctcagttacttgatatgtctctaactgaatttcattataaattttcaagaataactctttcaaattatttgcaatatggcgttgcataaattctcgcactgcataaataccgtccggatcgatcgttttgaataattcggcaaattcagtttcttttggcagtgttaaaatcgttgttactaaaccaatatcttgctggtaattttctaatacttgataaagtgcggtaagaatttcagcagaaaactccagtgccagtccttgttgataatgaattaagttacgtcgtaactctgcattaaataacatttgagccgcatcccaacggataaaatcatttccagcaaatttcaacagtatgattaattgttgtgtattgtaagcataatctaattttaccggtgcggaaaaatcacacaataacgctggtacaggacgtgtataaatgtgttgaaattcaaaaacttgttctttttgtgtaagatttaatacatcagaaagatctttgccatcagcctgtaaaaattgctccacaccgctttcatcgtataaagcgatttttattggaatatgtaaattgactttttccatctgatcggcagttggcgaggtaaattgtgagattttgagttgataaacgtgatttttttcgtcataaaaatctgttacaaccaattccggcgtacctgattgactataccaacgacggaattgggttagatcaagtttattggcttgttccattgcaaggataaaatcttcacaggtcgccgccttgccatcatggtctgcaatataacgttgcatacctgcctgaaaacctttttctcctaataaagtatgaagcatacggatcacttctgcacctttttcatatactgtaactgtatagaaattattcatttcaatcactttttccggacgaattggatgtgacatcgggcttgcatcttctgcaaattgtactgtacgtaaaaattttacattattaatgcgattgattgctcgtgaaccggtatctgatgagaactcttgatcacgaaatacagtcagcccctctttcaaacttaattggaaccaatctcgacaagttactctatttcctgtccagttgtggaaatattcatgtgcaattacactttcaatcgctaaataatcttcatccgtggcagtttgcggattagccaaaacaaatttagaattaaagatatttaatcctttattctccatggctcccatattgaagaaatcaaccgctacaatcatataaatatctaaatcgtattctaaattgaaacgtgcttcatcccacttcatggactttttcaatgcactcattgcccaatgagcacggtcaaggttaccccgatcaacatataattccagtgcgacattacgaccgctctttgttacaaaattatcctgtaataagtcaaaatcacctgcaactaaagcgaataagtaacttggtttagggaaaggatcttgccattcaacccagtgacgaccgtctttcatttcaccacaagcaagacggttaccgttcgataaaagataaggatatttagttttatccgctgtaatttttgtggtatagcgagcaagcacatcgggacgatccaacatataagtgatttgacggaacccttctgcttcacattgcgtacaaataccttcaccggattgataaagcccttgcaaagatgtatttgcactagggtttagatgagtaacaatttctaattcaaaggtatcggcatttacggtagttaaatccaacacgaggctttcagcatcttgttgataatatttaaactcttcatcattgagtttgactgaaacaaattgaaaactatgaccatcaagacgtaactgtttgctttcaggattaagacgttgaaattgacttattgctgttacgatggtttgttgcggatcaagttgaaaatcaagataaatatcagtaacagtaaaatcaggggattgataattctttctatatttggcttttttttgcataatgacaacctaaatttattgagaaaaactatgctaggatatgatttttcgctaggtatttcaagttataacaattaagggagcgtttcgctcccttttgaagttttgttaggctaattttaatggctcaattttccatattttttctgcatattctaaaatagtgcggtcagatgagaagaaactcatattcacaatattttgcaatgcactttcaacccaagcatcttgatttttatatttttcatccactgctttttgcatctcaacatagctacgaaaatctgcaaaagattgataataatcgtaagaacgcaatgaatttaacaaatcatgatagcgagtaggttctttgggtgagaaacgacctgcattaatctgatcaataacttcacgtaattgttcatccgactgataaatatcaaatggatgataaccattacgccgtaactcttctacttgctctacggtattaccaaaaatgaagatattatcttttccaacattttccaatatctccacatttgcaccatctaatgtccctagcgttaacgcaccatttaaagcaaatttcatattgcttgtaccagaggcttctgttccggcaagcgaaatttgttctgaaatatcagctgccggaataataatttgggcaagactgacactataatttggaataaacacaacttttaaacgaccttgtaaacgatcatcattattaatgatatttgccacatcattaattaggttgatagtttgttttgctgccgtataagctgaagctgctttaccggctaaaataaagacccgaggtgtccaatctttttctggattagcaatcatttcattgtaacgagcaacaatatgtaacacattaagaatttgacgtttgtactcatggatacgttttacttgaacatcaaatagagcgtttgaatttaattcaatacctaactcctgttttacataattcgctaaacgttgtttatttttacgtttaatctctggaattgcttttttcaattcaggatcttgaatatgtgctttaagcgtttctaattgagttaaatctttacgccattcagtgcctatatatttatcaaataattcggataaatcaggattcgctaccgcaatccaacgacgaggggtgattccgttagtgacattggtgaaacgttcaggataaatgcgataaaaatctgcaaatgtagaacttaccattaaatccgaatgaattgctgccacaccatttactttatgcgatccaacaacagatagccaccccattctcactttacgtatattaccttcctcaatcaatgatatacgacgaataaagtcgttatcagtagtaacagaggtgcggacatattctaagaaataatcgttgatttcaaagataatctgtaaatgacgaggtaatatcttcgccatcatttctaccggccaagtttctagtgcttcagacattaatgtatgacaagtataagagaatatctgacagcacatatcccaagctttttgccaagtatatccttcttgatcaattaaaatatacatcaactctggaatagctaaagcaggatgagtgtcgtttaaatgaattgcaattttatccgctaaattatccaatgtattataaattcgcttatggcgtttaataatatcttgtagagaagctgaaactaaaaaatactcttggcgtaaacgtaattctctgcctgcagctgttgaatcatccggataaagtactcgagaaacattctcactagaagatttctcttcgatagcatggaaataatcaccacgattgaatgacactaaattaaaagtttcacctgcgtgtgcgctccataaacgtagtgtagctgcactgtcattgctatatcccggaatcatttgatcgtaagcaagtgcggtgatttcttctgcatttttccaaatacattttttcccttcaaaataaatatgccctccaaaacggatattaaagcgtttagacggacgaataaattcccaaggataacctttttctaaccacgcatcaggtttttcaacttgtttaccatcttcaatatattgctgaaacataccatattcataacgaataccatatcccataccgggtattgcaagcgttgcgatagagtccataaaacaagctgctagacgacctaatccaccattgccaagaccgggatcaacctctttctctaatacatcttctaaatcgacattaagatcagacaacgcatctttagctaaatgatatacgccttcagaaattaaggcattagataaagtacgccccatgagaaattccattgaaagataataaactcgccgagtttcttcttttcttgcttgacgagcagtggaaatccacccctcggttactaaatcacgtatggcatataaagttgcatttagccaatcacgttgacttgcctcctccggggaacgaccaattaaaaaaactaatttatatacaatcgatttcttcaacgaatccttcgtattttccggacgattataagaaaaaggaaggggaagtgtatttaccattaggctcaaactcctgatttaataaaaaactaccgaattttattcatctgtataaaaaaaacaataaaattttataaaaaataatttgaatatttctactcaaattatttcgctaaaaaatttatttatgtaaaagaatatcatatagggattgatatccttttgcagatgtctgccaactgaaatcctgttccatagcattgactatcacactttcccattgacttggtttacgccacaaagtaaatgcactatcaataccataacataatcccccaacatcagcatcattaaatacaaatcctgttgcatgacgtgctttgatgttttcactgctactatcaatgacagtatcagccaaaccacctgttgaacgaactaacggtaaagttccatattttaatccgtataactgcgttaaaccacaaggctcaaaacgacttggaacaagaatgacatctcctccggcaatcattaaatgtgataatgcttcatcatatccaatttttactgcgatattttccggatactcttgtgcaagccaattaataccggcttctaaatgtgctgaaccggaacctaaaattgctaattgcccaccttgttgtacaattctctcagcactaccaattagtaaatctacacctttttgctctgttagacgtgtaaccattacaaataacagtgcattaggattttgtggtaaattaaaataagcttgtaattttattttattcttacgtttaccctgcattgatttcaatttgtaatgatcttcaatatacggatcactatacggatgccaaattttttcatctacgccattcaaaataccaaccaatcgtccctgtgctttcaaagtttgcaacaacccttgtaaaccataagcaaattcaggtgttgtaatttctttggcataggttggactaactgcagtagaaatatcggaataatacagtccggcttttaaataagacatttcaccatataattccaatccatctacattaaacatccaccaaggcaatccaatttcagttagatgataaggtaaaaaacgtccttgataggctaaattatggatagtaaacaccgatttagcaggacgtcctttatgatgcaaataagcagctgttaatcctgcatgccaatcatgagcatgcacaatttcagcacgccaccaaaagtctaatcctgtagtcaactctgccccaacccaagccaataaagcaaaacgcttatagttgtccgtataatcgttataccacatatcatgatatggattaccttcacgggcatataaatgcggtgcatcgattaaataaacaccaataccattgtattcaccataacgtagtacaacatgtccggcaaaattatcaaattcagcaactacaacggtatttggaataccacgagaaatagcaggataagccggtaaaacaagtctggcatcaataccaatttcattttgtgcaaaaggtaaagcccccattacatcagccaatccacctgtttttaataatggatataattcggaacaaacatgtaatactttcattgttaattttaatcctcccatcaaggcggtaaaaataaaaaattctaccgcacttatttatgtttacacctagtctaaatgaatttcagcgacaactttttcgccatttaattttttcatcatcgattcagttaccaaaataacttttccggtactacttacacggaagcgtttgcgatcctcttcaatatttacaccaataaccgtgttatctgggataactacttggcgatcaataatacaattacgtaaaatacaatttttaccaatagttacttgaggcaacaccactgaatattctactttagaatcagctttcactttcacttgatcaaataacacagaataactaatttctgcatcagtaatcacacaaccaccggaaataagcgaattatctaccggtttaatatcttgcttgttatagaagaattttgatggataagtttgggtcggattaccgcgaattggccagcgttgatcataaatatccaattgcggatgttcagatactaaatcaatatttgattgccaaaaactatctaacgtccccacatcacgccaataaatctccccatccgtattacgtcccatacaagatcggctaaacggatgtgcatataaaacttcttcctctaaagattttggcagaatatctttaccaaagtcatgagaggtatacggtgtatttacttcacgcatcaatacatcatatagataatctgcatcaaacacataaattcccattgaagctaaagaagtatccggtttatttggaatcgccggtggatcttttggcttctcaacaaatgcttttactttcaaattttcatccactgccatcacaccaaactctgatgcttgttcacgtggaacttcaatacagcctacagtacattttgcattgcttgaaacatgatctaagagcatttggctataatcttgtttataaatatgatcaccggctaaaattaaaatatattttggacggtaatgatcacgaataattgccatattttgataaaccgcatcagctgtgccacgataccaagtagaatcatcaatttgctgacgtgccggtaacatatcaataaattcaccacgttcttgcggtagaaatgaccaccctttttgtaaatggcgtaataaagaatgagcagcatattgcgtgacaaccccaatgcgatttaagccggagttaatacaatttgataaagcaaaatcaataatacgacggttgccaccaaaatataaagctggtttagcacgtttatctgttaattcgtgaagtcgtgagcctcgacctccggcgagaattaatactaaggtatctttaacaagtttatgtttacttaaatttttagtaatactgttactcatagcaactccttatcttttatttttatactcacgactaactcacatttacttgagttattcactttttctgcaacacaccaaaagccaaatccgtcatctccaactgcttgttttctaaatgtactacttttgaataacacaaaatctcccaattgccttgaggtaataagaatttttgtgaacttgtttttgcgttgataacgaacaggtatttactgtccagcaaaatctgcagagctttgctccctttattatgccactcatctaatgacatcttctcagcatcaatatttaaccaagatacattgctctcctgccaccaattatcccgttgtaaactcggaatttgtttacgcaatgcaataacttgcttaaccaaattaaagagatcttgttcaaaatattgccattttaaccatgttgtttcattatcttggcaataggcattgttattaccgtactgcgtattaccaaactcatcaccagccaatagcattggcgttccgtttgataataacaagctcagtaacaacgcactacgacttaaataacgagcttcttcaacaagagaatttccctctttatatccttccataccatgattataactataattctcactccgcccatctcgattatcttcaccatttgcccaattattcttttggttataacttactaaatcatgtaatgtaaaaccatcatgtgcggtaataaaattgacagaattatgtggtaatttcccctgacaactatatatatcactcgaacctgcgaaacgctctgcaaaaacaccgagttcaccgcttttccataaccaaaaacgacacatatcatcacgaaatcggtcattccattcagcaaaatacgctgggaaattacctacttggtatccgcccatacctatatcccaaggttcggcgataaatttaactttttgcaaaattgagacctgctcaatttctttaaataataaggcattagcattaaaatccggcgtttctcgtcctaaaactgaggctaaatcaaaacgaaaaccatcaacatgacattcttctacccaatagcataaacaatcaattatccattttcgtcctagttcagtggataaattaagtgtatttccacaacctgttagattaatgtagtttcccgcttcgtcctgccaataataagtccgatcatcaattcctcgttgactaaacgttggaaaatgcttttccgattcaacagaatggttgaacactacatctaaaatcacctcaattccctctttatgtaatgcttttaccattgatttaaactctgttaagggtgttgtatcggcttgatttgaccaatatttggactcaacagcaaacatcgctaagggactataaccccaataattctgtagtcttttctcctgcaagtgcggttcatctaaatgataatttattggcaataattccaccgcacttacacctaattctttcaaataggcaatgacgttttgatgagctaaacctgcataagtccctcgaattgcttccggaatgtcctctcgcaactgagtaaaaccttttacatgcaattcataaatgatactttctgaccaaggtgtttggggtaaaatatctccttcccaatcaaaagatgacgattcaattaacgctttaggtgctaaatgtgcattatctctctcatcttcaagtaaaaaccaagctctattttctgcacaacttaaatcaggtttaccaacaacagcttttgcgtaaggatctaacattaatttatttggattagataaagaaccatccacgccatgaatacgaaaaccatattcggttccatattccaattcagctacccaaatatgccatatattttctgtacaatacattgaataacgggtttcttgaacagaatttttattaaaaatacaaagttcaaccgcacttgcctgtgaggaatagattgcaaaattaaatcctgcaataccttccatacaacattctgtacaacctaaaggatatggtttacctaaactcatcttactcataaatattcaaattgtttttatacctttagctaacgttgttttctactgatgtcgattctgcaatcacctctgcatttggaaaaacagcactttcctcgttttttacttttttaactaccgctctttttgttaccgtctttttaggcttaacctctgttgcctcagagacagtatcagcgacagtttttttggttctcgtggttttaccctttgctatttttttctctgttttcaccgctgtatcttcaactttcgaggtttttctcatttttctgactttttttactttatgcagtttaagatacactgttgctagaggaggaatatcaatactgatagattgtgctttattatgactttcaatatcttcagttacaattttgctcgtatttgtcgaatttgatcccatatactgttgtgcatcggagtttaaaatttccatatattcaccggcaatatttacaccaaaacggtaattttgacgtaaaacaggggtgaaattactgataacaataatacgttcatcttttttactacgacgctcaaaaacaaacacggaattttgataatcatcaacaacaagccattcaaaaccttgtggatccgtatctaactcaaagagcggtgcatttttttgataaatatgattaagatctctaacataatcctgtatagctttatgccagccaccaccatgaaattcatcaagaagataccaatccaaactttcctgataattccattctctgccttgagcaaattcattgcccataaagagtaattttttacctggataaccccacatataaccataatatgcacgtaaattagcaaatttttgccacgcatctccgggcattttaccgagtaatgaacatttaccatgtacaacttcatcatgtgaaagcggtaaaataaagttctcactatattgatacaccataccaaaggtcatttggttatggtgatgttgacgataaatcggatcttttttcatatacgacaatgtatcgttcatccaacccatattccatttaaaatgaaaacctaaaccaccttcatacggaggatgagtaacaccggcaaaagaggttgattcttccgcaattgatacaacaccaggaatttccgttcccaataaatgattagtttgtttcaaaaattcaatggcctccaaattttcacgaccaccatactgatttggtatccattgcccgtcttcacggctatagtcacgataaatcatagacgcaaccgcatctactcgaataccgtctaagccaaaccgctccatccaatacaacgcattcgaagccaaataattttttacttcatgacgaccgtagttataaatcaaagtattccaatcttgatgataaccttctttgggatccgcatgttcatataaagccgtaccgtcaaaagcaactaaaccgtgcgtatcgcttgggaaatgacctggaacccagtctaaaatcacattgattccagccttatgagctttattcactaaacgtttaaaaccttcggctgtaccaaaacggctagtcggagaatacaaaccaataggctgataaccccacgaaccgtcaaatggaaattcagagattggtaaaagctcaatatgcgtaaatcccatgtcttttacatagggaataagctcatcagcaatttgatcataatccagccaaaaattattttccaagttacgacgccaagaacccaaatgtacttcataaattgaaatcggctgatcagcttgattagcttttcggcgtttttcagtcattgatacaatttcaggcaatgccccaatttgtgaggctgtatcaggacgtaattgtgaactgaaggcataaggatcggcttttaagcgtaattgattatgacagtctaacagctcaaatttatacagttgccccaacgatactttgggtaaaaataattcccaaataccgctagattgatgaaaacgcattgggtgccgacgaccgtcccaatagttaaaatcgcctacgaccgaaacacgtttagcatttggtgcccacagacgaaaatttacacctgctacgttgtcacattcggtaaaatgtgcacctaaaatttcataagggcgtttatgggagccttctgccagtagccaattatcaagttcattaatcatcggatgaaatgcgtaaggatcttctataacttgagcttcatttccccaataaacttctaattgatacgcaaaaaaactatgcgtattaggcacaactccggcaaaaaaaccacgttcatctaccctcgataattcacaaagtacattttttgtttctttactgagaacaaatactttttcagcatccggtaataatacccttacttcaatcccatttgacgtttcatgcatacctaacacggaaaaaggatctgcatgttttccatcaaaaaaagtatcaatggtagattgtgatacaaatttattcataaaaaccctgcctatttatttcttgcctgattaattgttctaattaatgaaagtactgttttatcagtaaaaattttttctagcggttgtaataatttcttacgccagttaggatattccgttgaagtgccgggtacgttaaataaaacctcttgacgaagtaaattttccagttgtacacctattaactgcgtttgactttcagccaaatattgatgaataacatgatttaaattatcgtgcatcgccatatttaacgcatctccccaataattaggcggcaaatattgatctcggtgcaaagtatcaagcaatgcttgtttatctactactcgttgatcatattttgattttaaaatatcttctttcaacatgcctaactgagcaaacagttctaaatcgtgacaatgccaaaaactctgcaatgaaggaagatcatgagttccaactgtagcaaatgcttgcaaaggaaaatgatctgctttcggatattcgttgtgttgttgctcaaaatacagaacaaagtaagagaacactttaaattcatccaatttaaaccgcacttcattaggtacagtacctaaatcctcaccgacaattaaacattgattacgctgactttcaattgccaaaattgccatcaactctgcaaaaggataatgtacataaagtccatcacaggcactttttccttccggtatcaaccataagcggaataatcccataatatgatcaatacgtaacacaccaaaatgctgcatattggatcgcaacatatcaataaaaggttgaaagccacgagcttttaaaattgttggattataaggtgggatattccaattttgtcctaccggtcccaaaggatccggcggagcaccaactgaagcgttcacacaataaagtgttttatcagaccaaacatccgcacttcctctcgaactgcttacagccaaatctccataaattcccaacgacatacccttttccaagcacaaattttttacttcagttaattgggtattagccaaccattgcaaccaagcataaaaatccacctgtgttttatattttcgtaataaattttgacgctcttcatcggttaaaaattgccattctttacgccaacctaaccaaccaattttattttcatcttccggcatattttgatgttcaatgctatctaatacatcaaataaagcctgagataataaagcgttaccttgtgcttgcataaaatcagcaaattgacgacgacgctcaatgattttacttgctctactacgtttaaaataagcgaacaactcatctaatacgaaacgttttaatgacattactgcctgataatctacaacctctgaccgacgtaattcagcaagtttggcttgaatatnytctcttctaaaccaattttggacttttttgcataaattaaattcgggtaattgatcgacagccaaatacaaaaaattcaaccaacgtcttgacgaagaactgtacggacttgcccattcaggaatagccggataaagttgatgtaacggattaattccaataaagtcagctcccagcaccgcacttttctcaattaaatatgcaagatcggcaaaatcgccaatcccccaattgcgagcggaaaccaaactataaagctgaacattaattccccatgcttttttacgttgaaatactgtcggttgataagattgttgaggcgaaactaaaatgcgaacgacatagttctttccatttatttcaagaagcaacgaataataaccataagctaaaggagataatgttagttttttctgctctttaagaagttggctccaagacaggaagttcccattatcatcatacaaagaatattgaatagaaatgccggaagataaattaaatgcggttaagtcataaattataggttcattttcactgacgactattacatcatcaaattttttatcttctgaaccgacttccgtttgactcagtaattgaatgaaataatgcagactttccggttttgcgtaaatcaaattaccatcaatatcataatgagatatggcaatccctattttttctgcatcttgttgtaattgattagaaatgcccatcttactctcaaaaagcttaaaaagaattaaatcaatttcattctatctaatcttaactgacaaaagcaaacgcattactttaaattgtgatccagttcaaatagaaattttaagttttttcatcaatcacaaattcaaaccaatcaatcacatctttttcatgaataccctgctcaatcatcacaccagcacatttcatcgcttgagaatgaccaacgatgagaggatgccaatcaaagagcggtttattttcataaagtaaacgataagcacaagtactgggcaaccaactgaaatgtggcaaatttgctttagttaattttgtacaatctttctctaagcgaaaacgtttctcataatgaccgcactttcccgtttctaaattcaatagattgcaagcaatacgagtaaaatacagcttttgtcgttttcctcgcccttcaataaacttacggtaacagcacttgccacaaccatcacaaagtgcttcccattcttcatcgttcatttcaagcaaagatttatatttccagaattcaggggataaagtcatttcaaaaaaaaccgatactatcatcttaaaaaaataatccggttaaatattattcaaccggactcgtagaatattacccaattcagggagtgcggaatttaaccgcacttttattactgtgtcaatattgcttcaaatctaaattgagatggcaaaattttatgggataaagcctctatattttgttgagttacttgctgtaataactgttgctcagcaaacataagcaaaggaccatcactcaaagaataactttgttccaattgagataaaatggctaacaatgattcctttgcctgttttaactgagattgtttttcactcacttttttagccaacaattcaggctcaatgccttgtttaagtatttgatctaatacatgatgagtcatctgcgttaattcctgtacacgcataggatcacaactaaactctattttcccctcaatttgaggtgaaaaatgttcttgttcaaaccacgcatgcactgcatagatacccgatgcctgttctcttaaactcaaccgtaatttctcttgtatgatatccgctaaaatatccagtaaatatttgttttccacttgccattgatgatcagctgcgaaatacatttcaacttctgctcttggctcatgcaagcctttaacaactaaacgctgctcgggtacatgtgcctttatcggctgtaatactctattttgtgttttaaccggtacattggctaaatatttttcagccaaattttgtaccgcactttcgctaatatcaccaacaataaaataagtgaaatctgttttatccgtaatatattgctgataaattgcggaaagtttatctgccgttaaatgcagattactgaaacgatttgcaccatatagcgtttcttgttgtggaaaacgcaattgctctactttctgcataaacgtcttttccggacttttttcattcacttcatcctgtaaagtttggcgatattcggctaagactttatctgaaacagggctggtttgtagttttaacctaaataattgtagaatatccgctaaactttctgttttacctgctgccgtaaaaccctgatcagcctcatcaataaccgtcgtaaaagctatcggagcgtgactgaaatactgatcaatatcagcctgaggtacaatgccaattccagtatcatcgaccacagaaatcgccgctcttaacgcatgataatgtgatcttggcacagaacgtaatcctcctgctgtcaaggctttaaaatagacttgttgcggacttttatcactatacatataaatcaatttactaccgttacttaacaaatattcagtaattttttgtccacgccatactttttgcttagtggcatttccggcaactaaatctaaatgcggaagctgaactaccctattatcttgttgttgccaagaagattgcgattgctgtaaagcctgttgccatttttgtgctaaccactgactatcaaacgataatttgtgcggttttggctgagtaatcagcaccaacttggactttaactgcaacatttgttgaaaagtgcggttaatatctgccaaagtcagttgattgaacaattgatgatttaattcatattggtcttgaggagagagtaacacttgatcatttgccatagtaacgaccaattcgtcagcaattttgatactactcacttccaaatgtcgttgtttagtatttattttacgcaaacgctgaagttcttcatccaattccgtctgcgtaaacccgttttgagcaatttctgcaataaagttaaagagttgctctgtcgctttttgataatcctcattctcaagttgtaaagaaaatgtggattgtaacgtttgcttacctaaataatcatgataaaaattagcagattttacgaccgcacttgaagactgctgtaaatatgtttcccattgttgcaaacgtaaattaagcaaacgcaccacaatttgttgccataaattctctcggtattgtgctaccgtattgatattttctgccggtttaaaaaaactcaagtccaatcccggttcacgcatttctttctcagacacggtcgctaaacgccatttaggcggtaaaggaatatcaaaatcaatctcgggtaaaggttggtgttgtaacggatggctactccctaatttctgttgaattaaagacttaatttttaccggattcacatcacctaccacaataagactgacattatccggacgataccattttcgataaaaatcttttacacgctgtgccgaaacatgtttaatgacgttgacatcaccaatcggatctcgttctacataacgtgaccccgccatttctatttggctttttttatcccctaaacgcaacataggacttaaacgtgatcgccattcttccaacacaattccacgttccgcctctaaatccgctggtaaaatggtaagatggtttagccattgatcaataacattgaatgccaagctaagagattgcggatcatttttagcgatatttaatgtataaaccgtattttcaaaatcggtaaacgcattaatatcacgtgcaaacttcattcctaatttctcaagtgcattaataatttgattttgcggatattgttgcgagccattaaatgccatatgttcaacaatatgggcaacccctttttgatcatcatcttcgtgcatcgaccctgcattaactaccaaacgcatatacacacgattttgcggaaaatgattaggtaaaatgacataacgcaagccattttccagttgtccttgataggcttgcgaatgaaaaggtaacgtatctttttcatgaaataaggattggcaagcaccaatccccaaaagagcggttaaaattagcaatattttttttaacattagaattcataccccaattcaagccaaaattcacgacctgctgcgtagaaaccattatcctcgttagaacttaacccctttctcgtttgattaaggacattcaatatatcaaatttcacaatcgcagaatgtttgccaaagattttaggttgccaacgaaggctggtatcccattgtgtatgggtgccgtaattaaaactgcgataaatcggtaactgactatttctactacctgtatccaattgtttaaacccttttataggtgcttttacataaattcggttggtccattccaaattataatttggcatagacatatccacgccaatccgagccatccattcttcacgattgttattaactttagaccgcatttctaattcggtcatttgttttccgtctaaaatcacaatggaattcgggtcatatcctacacctatatcaatacccttggtatttaaccaatcaaaccccagcgaagctcgccattctgtctgccaaaatttccaactgtctttattttgaatttgcaacgtatatacattattgctgtaatctttgcctcgtgcaaaatgacgcacttttttacccgatggaccatcttcttttagtatgatgcggtttttattttgacgatgaatatatcgggcatcaaggataacattcccgagttcttgattaatactgaaactcaattcatcactaaacggcgttttcatggatgagagggactgataacgttttccaccaccattaccatctatatcatctaatttgaaaataccctcacttaatttcatggaggcaaaagagcggccataataacggtttgctccgagacttaatttagtttgttcaaaaggttgatagcgggcgacaaaacgaggggcaatattggtatttttaaggaaattatcacgctctaaacgtaaccccggacgaamyyccmatttaccccccagcttgattaaatcttcgacataaagggcgatattgtgataatcggtttttactgttcctttggaaacggaatttgaagaaagaggactttccatactgtcctgcatgaaaatttcagatttagcattttgatcacgttgaaaacgatagtgcgtaaattgccagataccccctaaggaaatagaatgttcagtacgtccccaagtcaacggatccatagcaaattcactggaaaaatgcacattgcgttgcgttaaagcactatctcccattcctccacgttcataattaatcggatcatagttttcatcaaatgccaatatttgcttcaaataattagaggcggatttacgcttatctgcaaattgatcatacgccaatgtattagttaacacaccgctctttaacgaacgaatccaagctaaagtagcaccataggcttgatgataatcttgcacattgctatcaacattctctgcaaagaatttagtttccacataattagaataacgcaaactcaattcaaagcgattatcctcattagcaagccagttaaaattcaacaacgcattatcggaacggcgtttatgtctgcgattatccgaactcaacttgttatcttttcccagcactaaacgacgttgctgaatatctgaagtacggcgactaaatcctgctaccataccgatattttcccctaaagaatgttgtgcagaaaggctgaagaaatctttgctatatttaggttgaaaatccgcactactaccgttaggcgaggcttgtttaaatttttctcgatctttttcctcaagatggaatttcgcccaattagaatggctggtacgataacgcagttgcacaccatctgtaccgtcatattgcttggttttggcgactacggcaccgccggcaaaaccgcctaaactggcggaaatatcgctgtcgtaaacggttacggaagacaataaattcgcatcaaagaaataggcttgtgcatgacttgccataggcaaagtttgcatcgctccctcaaaaatttcagagtcaaatcctaaatcattattgatattgacattatctacaaaataactggtttgactggcttccgcaccattaatcgaaatgtcagcaggtttaatttcacctcgttgaaaactgttttcatcactacgttcaaaacgcacatgagaattggttttcaaaaaatcagaaatattgccgttggaattaggggaagatttaatatctttggcggttactttttggctggaagataatcctgcgttttgctctgcataaacaacaacctccggtaattgattagctcgttcaactttatttttacttgtttctgcttgagcggaaaacgctaaacagacgctgacagctaataaggtttttttagtttttaaatcataaactgacataaattttccttaattagatataaatgataataattcttataaattttatcatctaaattttttaatgtaaaaatgttcatcgcttgcagaaaaaaaataatccgaccataggtatgatcggattatgtgagaggcattaaaatcattaaatatactcagtaatacaaccgcacttttggcgaaaaggaactgatattaaaacccttctttcagactgacagttagattaaaaactaagttatctgcattactgtctttgctatcggcacaataatacccttcccgttcaaattgatacgcttgttcggctttggcattagcaaggctttgttcaactactccacgcttaatgattaaggaatttggatttaacacttcattaatgtcttccactgctcccggattcgctacggtaaacaatttgtcatacaaacgaaattctgccgataaattatccgttgctgacacccattgaataacaccttttactttgcgtccctcaggatttttacctaatgtttcgggatcataagtacaatatactgtggttacacaaccttccgcatctttttcaacacgttccgctttaatcacgtaagcattacgcaaccgcacttctttacccaacactagacgcttatattgtttattcgcttcttcacggaaatcagcctgatcgatataaatttctttggtaaaaggaagttccctcgttcccaattcttcacgatttgggtgattaggtgcggtaagtatttctttcccatcaaaattttcaatcacaatttttagcgggtttaatactgccattgcacgaggtgcgtttgtgtttaaatcatcacgaatacagctttctaatgcactgtattccaccacgttatcctgtttagttacccctatacgacgacaaaactcacgcaatgatgcaggggtataacctcgacgacgtaaaccggaaatggtaggcatacgtggatcattccaaccgtcaacaatcccatcattaaccaatttcagtagcttacgtttagatgtcaacgtatattctaaattcaaacgtgaaaattcatattgatgcggtaacggacgctcaatcgaaatattatccaatacccaatcatataaacggcggttatcttgaaattctagcgtacataatgaatgagtaattctttcaatggcatcggaaatgcaatgagtaaaatcgtacatcgggtaaatgcaccatttatcacctgtttgatgatgacttgcaaatttgatgcgatataacacaggatcacgcataaccataaaaggagatgccatatcaattttcgctcttaaacttgccgctccttctgcaaactcgccttttttcattttttcaaataacgccaagttttcttctatgctacgatcacgataaggactgtttttacctgctgatgtaagtgttcctctatactcacgaatttgctcaggtgaaagttcatcaacataagccaacccttttttaattaattcaattgcataactatacagttgatcgaaatagtcggaagcatagcgaggctccccctcccattcaaaacctaaccattttacatcttgcttaatactgtcaacgtattccacatcttcttttactggattggtatcgtcaaaacgtaaattacatttaccctgataatcttgtgcaataccgaaatttaaacaaatcgatttagcatgaccaatatgtaaatagccgttcggctcagggggaaaacgagtataaacattatgatgttttccgctagctaaatcttcatcaataatttggcgaataaaatttgttggtttatgttccgtattttccatttcaactgttatttcgctcattttttgtcctcaatgcaatttgataattaaaaatctgcgtattttacagtgttttgcacagaatacaaagtacagcggattttatctcacttggcatatctgtacattaccttttgtaaactttcaggtaaaatagcataacttctaatacaggtatttttataccgcacttatttttcatgaaaaggaacgtttatgtctgatttgaccctacacagccgacatacctatttagatcaagtcaaacacattgtggcaatcggtgggggtcatgggttaggacgtgtcatgtctgcattgagctttatgaatgagcgtcttaccggtattgttactacaacagataatggcggctcaacagggcggattcgacaaactcagggcggcattgcttggggtgatttacgcaattgtcttaatcagatcattacagaacctagtacagcatctgctttatttgaatatcgtttttccggtcaaggtgaattagcagggcataatttaggtaatttaatgctgaaagcactggaaaatatgaatatccgtccaacagttgcggttaatttaattcgagatcttctcaaagtgcggtcttttattgtgccaatgtctgaaagccctgtacaccttgcagcctccttgtctcccggtaaaagtatcgttggagaagtaagtattgatcaattaaccgaaatccctacatctatttttttagttccattagtacaggctaccactgaagcaattcaagctttaaaaaaagcggaagtcattttattcggtccgggtagcttcttaaccagcattatgccgccattattactaccagaaattattgaggtgctgaaaaatagtcaagctaagaaaatccttattgataatttaagtgtagaacacggtcctgccgccaaattatctttaatcgatcgcattcaatggattaatcaaactattggttgtgatattattgatggtgcgatcgttcaaagcaagccgcaacagaattatcacacctcctcaataaaaatcatggctcgccaacttaaagccgatgatataggctaccgccacgaccgcactttactttgtaatgcgattgacgaattattgacagaattagctcatcatttttcacctaagcaagtttgactaatttagctggaattccttgtctaacagcggagccacatacccaatcaacccaaggcgaggcaatctctttggtactatctaacaaaccaagatcattaatattaactccggaaccaatctgagcatttccttcaattaatttcccattaattgtataacctgtggcccccagttgtttatgtccataaccatgttcaatcgcaatcgtccctttaatgacaccgttcatcacaaccagctgcacaacagcttttcctcctggggtatttagctccacaaggtcaccatgctgtaatccatattccgtggcatcctgttgattaattgccacaataccattaggtttaatactatgtaatcttagtaaaggtgctgtaatactactcattaaatttgatttaaaggaaattaatttaaatggccattgtattttagggtaatggctttcaactgtgctattatcggcaaactgatcttcaaaatacgttggacagccgtgataatttttaccggtttgagcatgtttggcttttgctacattttcattccaaatttgcaaacagtttttccagcgagcctgcatattatcttcctgccatgcactgctatgaggagcaaaacgtccgcctttacagtaaattgtagccactttcttaatttcttcaggttttaacacttgttgtaaacttggcatcaaacgttgtacacccgttagcaataaatcttcttgagttgcatcttgtaccggctgttttccatcataagctatattggcagctgctcgtaaaaagaagtcttcactacgatttaaaggataggaatgattttgtttatctaagatagcattatcaccaaatccaggtaattgcatcatcttagcaatttcgataacaaaactttccatacaaatagtatcgccttgagatgttttctcattaggcgatgctatcacaggccagcgggcagtactggtttttgttggaacaccagcccaaggggtactaaatccccaactctcaaaattatgggtatccggcacaatataatcggcaagggcggtagtttcattcataaaagcatcaatagaaataaagagcggtaagattttcggatcttttaatttctgctgcgtaatatggtgaatacctgtcataccataaattggattccccatatgattaatccaagctttaagtgagtatggatagccttgtaaggcagaagtaatcatttctgacatttgtccgccaacaaaaggataccaagcggctttcgctggatatggagaaataccttgtgctactttttgtttaaattcactggatttttcataatcttttttactacgagctaaatttgttcctttgggtttaaccatattggggaaatttgcaagattgtaacgaggtccagcagcaaaatctttaaatttaccgccactcatactcatccccccttttttattcatatttcctatcatggcattaagtaacaatatcgcccatgctgtatagaaaccattgctatgcatagttccaccgtgggtaataactgccgcacgaggtccgtgagaagtaaactttttagcaagttgaataatagtatcaacaggtacaccacactgctcagaatattcctcaatggagtatgaaaaacaagattctttgaataattgtaaagctgatttagctaaaacctgtgagccgtctttaaggcttatcctgtcttccacaaaaagcaccgcactttggcaatctttggcagctataaatttgcctgtttgtcgatctttcaccaaaatatcactatcgctcaatttttcaggttcgggtaaatcctctatatgaaaatttctaatggcttgcccatactgcttatgatttggatcggcgataaataaatgtgttgcattacaaaaacttacgccattagcttgttgcatcgcaatttcacttggtatagacaaataatcttcgttataacgttcattttcaataatccaacgtaacatggctagtgctaaagaaagatctttacccggaataattggtacccagcgatttttatcttgtgctgcagttgaggtaagctctaaacgaggtgctatcacgacatattcaaaattatcctctgtacgcttcttagcaagctgacgagattgacgtttaaatggatttccggattgtgcaggagaagttcccataaacaaaataaattcaacatgatcccaatcaggtttagcatgagaattattagcaaagtcattcataaatgcaccggatccggcacgataggataaaccacaaaaagagccatgagaggcgaagttaatggtaccaaaactgttgtttgcaaaacgtttcagtagaggttgtcttccttcaggacctgcgaaggttaccatcagttgatttacttttgcaccaaaatcagggtgttgtgcattcactggcgtttgcaaatcacgaatcgcttttaatccatctacatgtccttctccaaatagatctccgccattcacaacttcatcaattaattgctcaaaactaatcgttttccatttaccttctccccttttacctactcgcttaagaggttgtgtaatacgataagggctatttatcccatctaaaaatgcagctccacgggcacaagcagtagaacgttgctgtaagccattttcaccagaaacgcttaactctgcttgtttaattgattgattataatcaaggtaatgatctgatgagagcgggtgataaggattaccgttaatacgcaatactttatttttttctaaatctattcgaacccgtaaaccacatagagtccagcaacccatacattgggtattacacactacttgttggctattggttaataaattgccctctttgacttgatattcaggtaataaagaatttccatttatattgtcttgtgttttttgtcctgaggaaccttcaattacgccctttgcaatttcttttactttgggagaataacctgcaacaaaagcagtagcggcagttgtagccaaagctccttttatcaaattacgtctttgtttattcatgatcttttctccccaaatttgattgcaatagtgtatgagatagcagttgccataaaataatacctactaataaccacaagctaaagacagctatcattccaattagcccatctacgttccaactcaattgatatggatttaccaaagcgttatattttgcgatttgctgtacttcaattaataaaatccaacgggtaagccaagtgatacaaagtgcggttaatattcgtaataaccttaggaaagttgaatgaggcaataacagcaatatgaacaaaacgaagatcccaatgagtaataacatcggtgaatagctaatttgccataatttcattaaatgaatagctgtttgctcagaaaataaataaatccccaaaatagaaactattaatcctaataaactggcgatagtaaagtatctgagagcataaacttgaggtataaaataatgacaaaataataagctgacgggtaaaacactaaatacgagcaaaggtaaaagccaagtgtgatgccataaaggacgagcctgtacagtgaagacctccatcgtggtatacattaaaatcaatattgtcataattaaagaaagccaaacaaaaaagactttaattaaatcagtattgaatttcccccaataaagccagtgaaaatacttaggaatagattgcattggaactgaggtacgtaatgaacataaaaaatatcctgccacggataaaacaaagaaaggtaaaaaccatgctccccaatacatccaagaccatatcgttgggttcaaataaaaattcataatacgacccggttgatgtaaatccgcagttaaggcaataggtgcaacaattgcacaactgaacgctaagctaagagcaagcaattcaagacgtgaatttttaataaaatgaaagaagaacgcagtcaaaacagatgaacaggctaatccaataaagaaaaaatagcttaccgcccaaggtagccaagcaatagcttgtggttctactaagatctcacgaataatcattctgctttctccttatcttgccataacattggttgaccgttaacttcattcacaaaagcatcatctaaacctagataaaatacatgtggaatggtaccgtgatccggttttaaaaccttcaaatcatctttaaattcatctaccattttactaattgtactggttggatcccgtaaatccccaataatacgagctcctcccacacaactctctacacaggcaggtaataatcctgcttctaaacgatgagtacaaaaagtgcatttatctgcagttttagtttctgagttgataaaacgagcatcataaggacaagcttgtacacaataagcacaaccaatacagcgtttgttatcaatcacaacaataccgtctttacgctgataagttgcttgtacagggcaaaccggcacacaaggagggttatcacaatggttgcataatcgaggaagtagaacattattggtaatattctgttcattggtgacttcatattgacgtacggtagtgcgaaactcgccaagcggtgtttgattttccaccgaacaactcaccgtacaagattggcaaccgatacaacggcgtaaatcaactaacatggcatagcgatgagcttcattaccctcttttctttccggctgaaaacttgtattcgcttgagaaaaagggataaaagcctgcccaatagttagtactgataagtttttcaaaaaacgtcttttgcttatgtacataatcacccctacctttaataaagattgagcattcaagttgatcaattcaggttgtctgaataccaatgcttaatcttcccactcacaaataaaatatttaataaaattgagttgttacctcttttagcgtattgttaaaaaatctccatgaaaaaaccattgtggttttccacataaaaatatgaggatattgatcttcatcaataaaaggaaataaagtgagaaagtgcggtcagtttttaaaaaattttatgttaataatggctttattgccccagttagcttttgcacaatcttggaaaatcggtattttggcacagcgaggaattgctgaagcacatgagcgttggcaaccttggattgattggctaaatcaacaatttgatgaacataaccaattttcattagttactctcgatcttaatgatctagagacagaacaagcacaaggagttgactttattttaagtaaccaatcccaatttttttatttaaataataaggaagttcgttggttggtaacattaaaatcgctaagacaaaaacaacatgacagcacaggaagagttggtagtgctatttttgttcgtagtgaaagtaatttttatcaattgaaagatttgaagaataaacgtataagtgcggtaggaaataaagcatttggcggatttttattaggttataacgaattatataaccaaggcttgatggaaaataaagatttcaagccggtttttacgggatttccggtagacaatacactactttttttagaggagaaacaggttgatgcagcaattgttcccgtttgtatttttgagcaattggtaaaagagggaaaaataaaagctgaaaatttccgtctattggcagaaaaacctaaccacattggttgtctggcgagtacagtcttactacccaattggtcattagctgcaatgccacaagtacccggtgacttggcatcaaaattaataaccctattgcttaatcaagcgtctgataatcttccgcaatggacacctccatattcaacaaatcaagccgataacatactgcatcagctatataaacacccgaaacaaaatttgtggcaagcaataaaatattggttctcacaatatcaattttggattactggtattattctgcttttattcgttaattatatttggataaattggcagatacatagaaaaagtaaagccttacaacaagcgtatcaacaacatcaaaaatatgaacaacagttgatacaggctgatagactttctattcttggagaaatgagtgcaggtattgctcatgaagttaatcaacctcttactgctattagaatgtatgtggaaggtatgaaatatcaagcagaagaacaaagaactcaaatcatattggataaaatattacaacaagtagatagaagtgcggaaattattcataacttaatgaattgggtaaaaggaaaaagtagcgaagatattgagttaatcaatctcaaacatttactaaaaaaagtgactcaattcatttctctacaacattataataaatttcaaattaatctggtttgtgcaacagatatttatttggaaataaaaaccacaattttagaacaaattctctgtaactgtttattaaatgccttacaagcaaaagcatcaatgatagatattatagtagagaaagagcaaaaagaactaaaaataagaattttggataacggaacaggttttcaacaaatagagttggattttccttttgttcctttccgcacaagtaaaaaacaaggattgggcttgggattagtattatgtcagcgtctaatccaagcgatgaacggtaatataaaactatcaaatagacaggatcaatctggggcagaagtgaccttaatcttacaaataaaaggaaaatagtatgaatattcatctacttgatgatgacttaacaatacttgatgccgctagttttttattggagcaagcaggttatcaagttaaaacttggtctaatagtcagcaatttgtacaacaagctaatatttttgagcctggaattttgttattggatatgaaaatgcctcatttagatggaaaagctgttcatcaatttttacagcaacaaaatagcccttttgctgtaattattatgacaggtcatggcgatatccaaatggcagtacaagaactcaaattaggtgcagtagattttttacaaaaacctatgcaatttagccaattacaatcagccattaaactggcgagaaaaaaaacaatggataattatgaacaatatcaaatcaaacgatgttataagcaacttagcactaaagaattagaagttttatctttattattaaaaggttatattaatcgacaaattgcagaaactctaaatatatccgtcagaacagttgaagtacatcgttcacatattatggaaaaaatgcaagcacaaacagcggcggaattaatctacaagatcactcttattaaaaaggacgaataatattcgccctaccgatctagtttactcaatttataccttcatttgcagtctaattgcatcagcaaccaattagcttttgcacctaatgcttttaactgattttattcaatactttcacattatcaaaccctttctctcgaagatatagagcctgtaacttactcatcacccctcgttcacaataaagaacataatttttactttgatctaattcagcgaaatgtgaagataatttataaaaaggcattaaaataatattctgtcctgagatttccagcggtttatcatcgacttcctccggactgcgaatatctaaaatcacgtcattagccgataaaaccgttatttcatcaacttcagatacttctttttttgtttgttcggcaatttgacgaatatctaaatattgtgcattttgcaccgcactttccagcacggaaaaatcaaaataactttcttcctgttcgattttttcttttacagcttttactgtcggacttttagaaatgacaccgcaaaattcaggcatagatttagcaatgtcctctgtaccaatttcttttgccttagcaataatttgttctttgtcatgcgtaattaacgggcgtaaaactaaactttcagccgcctcatcaattaaacgtaaattagttaatgtttgactagacacttgtcccagtgcttctcccgttacaatggcttgaataccaaaacgctgtgcaactttacttgctgctcgcaccatcatacgttttaacacaacacccatttgtccgttatctactttttctaaaatttccgcaacaacctgttcaaaattaatagcaacaaatcgcactttatgcgaaccgctaaaacgcgtccaaatatgatacgccatttgtttcacgccaatttcatgagttgctccgcctaaattgaaaaagcaataatgtactctcgaaccacgacgaattaacatgtagctggatacaccagaatcaaatccaccggaaataagcgataaaacatcttcttgtgtaccgataggataaccaccaattccctgatgacgagctttaatcaacatcattttgtcattttcaatatcaattctgacggtaacatccggtttgctcaactgcacttttgcacttgcaacggcttgatttaaacctccgccaatataacgttcagcatccaatgaactaaaatcatgttttcctttgcgttttactcgtacacaaaatgttttattctcaatctgagttgctacatcactcaaagtttgctcaaaaatatcgtgcaatgtgacaaaaggtttttcttccacttctaagaaatgatgtattccgggaatacgtccgagtaattcaaccaatagtatccggttttctatattcttcgaccgcacttcgatgtaatcccaatgtttaactactgcaacagtatcatcatatttatttaatacattgcgaatattaccggttagaattttcacgaaacgtttacgtacgctttcgcttttaatcataatttcaggaaaaagtttaataataaatttcataatgagtttacatagctttaatttgatgattttcagcacacgtttcgcatactgaattgccttaagtttcgtgacatattagcattcatgccaaatgatataaattaatttttcatttgctatataattttattcataaaatacagtacaatagacaccctgatttaagatgaagcaaggatgattaatatggcacagacacttgacaaaaatgcaactgatgaactcaactttgaaacaaccctcgctcaacttgagtctgttgttcatgtactggaaaatggcgatcttgctcttgaagacgcattgaaagagtttgagcggggtattcaattggctcaagccggtcaacagcgtttgcaacaagctgaacaacgcattcaaattttattgcaaaaaagtgaaaatgcagaattaagcgattatcaaccaagtgaataaaatagttagtttctaatgtatcaatttgctcaagatctccaagaatccaaacaacgaattaatttttttttagaaaaacaattcgagtgcattgatagttctccatctcctttagctgaggcgatgaaatatggattattgttaggtggaaaacgtattcgcccctttttagtttatgcaacaggaaaaatgctcggagcgaatttaattcaattagattatgcagcagcggctattgaagctattcatgcttactcactcattcatgatgatcttccggctatggataatgattcactccgtcgtggacacccaacttgccatattgcctttgatcatgctaccgctattcttgccggcgatgctttacaaccttttgcttttgagctgttaactcaaacacccgatttgtctgccgaacaaaaattagctttagttcaaactttagccaatgcttccggtgttaaaggtatgtgtttagggcaaagtttagatttaatctcagagaatcaacaaattaatttatccgcacttgaaaagatacaccgcaataaaacaggtgccttgttgtcagctgcagtgaagatggggtttatttgttctccgcactttgcaaatataaaattagaagaacaattaatgcactactcctctgctgtgggtttagcttttcaggtacaagatgatattttagatattgaaggtgaaagtatagtgattggaaaaactgccggatctgatctccttgccgataaaagtacttatccaaaacttataggtttagatggtgcaaaacagaaggcacaagaactttatcatcaagcactacaagaattggatgctttgccctttgacacttcagcattgcatgcactcgctgagtttgtcgtaaatcggcaaagctaagtgcggttaaaataaaaatggaataacaaataatgaataaatatccacttctctctctaattaattcacctgatgatctgcgattattaagtaaagacaaattaccgcaactttgtcaagagttacgtagttatttattggaaagtgtaagccaaagcagtgggcatttagcctcaggtcttggcacggttgaattaactgtagctttacattatgtattcaaaacacctttcgatcagttactttgggatgtagggcatcaagcctatccacataaaatccttaccggccgtcgagataaaatgtcaactattcgtcaaaaaggcggattacatccatttccttggcgtgaagaaagtgaatttgatgtgttaagtgttggacattcatccacatctatcagtgcaggtctcggcattgcgattgctgcacagaaagaaaatctcggacgtaaaacaatttgtgtaatcggtgatggtgcaattactgcaggtatggcatttgaagcattaaatcatgcaggctccgtacatacagatatgttagttattttaaatgataatgaaatgtcaatttcagaaaatgtgggggcattaaataatcatctggctcgcttattaagcggttcaatttattctactttgcgtgaaagcggtaaaaaaattctttcgggacttccgccgattaaagagtttgtcaaaaaaaccgaagaacatgtcaaaggtttcgtttccccagtgggaaccctgtttgaacaactcggttttaattatattggacctattgatgggcataatatccatgaactcatatcgactttaaaaaacatgcaatcattgagcggtccgcaattcttacatatcaaaacgaaaaaagggaaaggctatgctccggcagaaaaagatcctattggctttcatggagtacctaaatttgatcataaattaggggaattacctaaatcctcaacgacaccaacttattcacagatttttggcagttggttatgtgaaattgcagcacaagatgaaaaactgatcggtattacgccagctatgcgtgaaggctccggcatggttgagttttcgcaacaatttccacagcaatattttgatgtggcaatcgcagaacaacatgcggtaacttttgccgccggtttggcaattgcaggctacaaacctgttgtagccatttattcaacgttcttacaacgagcctatgatcaacttattcacgatgttgccattcaaaacctacccgtgctatttgctattgatcgtgccggcatagtaggtgcagatggacagactcatcaaggtgcattcgatttaagttttatgcgttgtattcctaacttggtgattatgacaccaagcaatgaaaatgaatgtcgtcaaatgctctataccggttataaatgtggaaaacctgctgctgtacgttatccacgaggcaatgcaatcggtgttaagttagaaccgcttgcagaactaccattgggtaaatcaaagctgattagacaaggtaaaaatattgctattttaaactttggtactttattgtcagaagcaacaaaagtcgctgaagatcttgatgcaaccgttgttgatatgcgttttgttaaacctttggatactcaacgtattcaagaaattgcacaaactcattctttgattgttaccttagaggagaatgcaattcagggtggagccggaagtgcggtagctgaaactttatatcagcatcaacaaaaagtttctttattgcaattggggctaccggataactttatccctcaaggtacacaaaaagaaatgctggctgagttaaaattaaatgctgaagggatttttgaacaaataaaacaatttttgcaaaaaatttaatatttttatgaactattttttatgttgatagtcttatagatcgctagtgcactgcaattgcagttgtctttttaatgttaaagtttcttatattaagacctccccgctattcaatctttgaatagcggttttttcttttttaacactcaacagctataaaagagcggtgatttttacaggtaatctgtaattagacttgactgataaccttaatgtggtaaaacaacgctttcaagtattttggaaggaatatgaatatgtatgaaggactgcttattgtattggttccaatgttcattggatatttaatcaaaacaaaaaataccgcacttttaacacgcataaatcatattatgatgatattgttatatatgatcttattcgtgatgggattttctctaggtcaattggatgatttagcgaaacaactaccgataattggtatctccgcctttacttttgctttaactattcaaggttgtaacatcgtaggattactaatttacgataagttaaaccctattccattaacccatttagtcaaaaacattccttctcgttggaaattacttctcgatagtgcaaaactttgtgcaatggtgttattaggctttgtgatcggtttatcggtaaaaagttggtttatgttaaaatttggtgcaagcacttatattctaataactttaatttttttcgtcggattacaattgcgtaataatggtatctccttaaaagaagtcttctttaataaacgtggactttatacaggtattatcttcgtttttacttcgttgttaggcggaattctttctgcttatattctcgacttgcctattacacaaggacttgccatttcttcgggatttggttggtattctttatccagcgtaatcattaataatgcttggggacctgtttttagtagcatcgcttttttaaatgatctatcaagagaaataactagcttatttattattcctttattgatgctaaactaccgctctaccgcagtaggtatttctggagcaacatcgctggattgtactcttcctattatccaacgttccggaggaattgaagttgtaccgttagcaattagttttggttttatcactaatattcttccccctattttattggtctttttttcctccatcccaatttagctaaaacgagagtaagacgataaaagtctcactctcgttttataagataaaatcatttttcatataattactcgactgctccgataagttaggaaaataattgttggctatttatatttatattcatcttgatagaataaacgagttaacagtaactttgatatcttatgtggggattagttaatatgatgaataaaaaaaatagttatagttacgaagatttgttagcttctggaagaggtgaattatttggtgaaaaaggacctcagctaccagccccccagtatgttaatgatggatcgtgttgtagaaatgaatgaagaaggagggttgttcaataaaggctatgttgaagctgaattggatattaacccgaatttgtctttctttggttgtcattttatcggtgatccggtcatgcctggctgcttaggtttggacgctatgtggcaattagttggattttatcttggttggataggcggtcaaggaaagggacgtgccttgggtgtaggagaagtaaaatttaccggtcaaattttacctacggctaaaaaagttatttatcgtattaatatgaaacgtgtaatcaatcgtaaattagtcatgggaatggcggatggtgaagttgaagttgacggtaaagtcatttacacagcaactgatttaaaagtaggattatttcaagacacctcaacgttttgattaaataattgctattgtgttaaaaaattgtagtttctacgaattttacatttatagagttatctagtttaaaaaagtgcggttatttttattaaataaccgcacttttcttattacttcacttcaccacaattcaaacaatataagtattgccctttgggatcattaaatttatttaaaatacctaattgctcagtcattttctgcattgatgtagaaaagccgaataaatgggcaatatactgacgaagattatgttctgaatgttgtttagcatttttcatcaactcccccaatagtgacggttctttttccgttagccaaacaacagaaaaatcttttatttcttctgaagatttctgtatcactaattctctagctttttcgactgcatcatcaaaactgcccagttgatctaccagtttatacgtataagcatcaaaacctgaccaaacttgaccttgagcaattttatcaacttgtgtttttgataaattacgcccacggctaacaacatccaaaaattgatcataaccatgctctatttccaattgaataatctcactgctgattttagataacgggctgaaatgtgatttcatcaccacatcagttgtcgcaacaccatcggcattcacaccaattttttgcatagatttttcaaacgttggaaacatggcaaaaataccgatagaccctgtaattgtattagggtcagcaacaatataatctgccgttgaggaaatccaataaccgccggaagccgccattgcccccatcgaaacaacgactggctttcctgatttttgtaaattatctacttcttggcgaataatttctgaagcgaacgcacttccacccggactatttactcgcaatacaaccgcttttatatttggctcatcattcgcctcacgtaataattgtgctatgctatctccgcccacattttgttcatcactttcaccatcgacaatagccccttcaacatttaccacggcaatagcaggttgtgtaggttgtgcaaatcgatttttcaatattgccaaataatcctcaaattcaacaaaatccaacttatcatcagaattaactatccaacgtttaatgattttttctcgttcttgcgttaccgctaattctgttattaaaccacgctttttcgcatattcagtctgatttccgttcagtgcttttaattcgctaaggtatgttttactatccggtaacacctgtgctaatggaatatcacgattttcagccacaatttgctgataacttttccataattggttaagccaacggcttgtattttcacgacttttttctgacattttatcgagcataaacggttctaccgcagatttataagtacctacacgaaaaatatgcggtgtaatttccaatttattaaatagcgatttaaaatacaaattctctgcaaccataccttctatcgccacttcaccttgtggatttaacaaaataacatccgcataacttgccaataaatattgactttgcgtatagttatccgcataagcaatcactggtttcttgctggctttaaaggcttgaatagctttcccaatgtaagttaacgcaggaatatctttcccatcaaaataattgagatcaagaacaagtgcggtaatttttggatcttttttagccgcttgaatggcattaacaacatcaaacgttgagatttttctcggtacatgttgattacctaattccaaaagaagctcttgccatgccgtatcatcgctacgattatctgccaaatagccgtccaaatttaatagcaacgcccctttaaaatgagttaaatctactttattcgacatactcgaattaaccgaaaacactgctacaatcaataaaacgaaaaaaagaaatactatattcattacaacacgacgagcaaaattgagcatttgccagcacaatttgagaaaggtcaacatcactttcatattatcctttactaagttaaaacaaatgtcgtaccttaccacaatttccttttacttcatatcgatcaaggtaaaaatgtgctagaatccaccgcacttttaagatgaaaaacaagatggaactaaaatggatgctctacaacttcttaccactcgtcattcagaaaaaaaattaatttcacctgctccaactcggcaacaacttgaacaaatttttcaagctgcactgcatacaccggatcatggaaaattacacccctatcgttttgttgttatagaaaaggaagggttgaataaatttacagagttactaaaagaagctgttttggaattagatcttggacaagagcggttaaaaaaagccgagaatttatcccaaagagcacctatgatcatcggtgtaattgccaaaataaatcctgatattgaaaaaataccggcatgggaacaaatgattaccgcaggttgtgctgcttacgctatgcaattagccgcaaatgcacaagggtttgataatgtttggatcagcggtccttgggttaaaggttctgctttgcgtcaagcctttgattgtgaaaaaaatgataaaatcattgcattattgatgcttggtacagcagaacaaaaaagtgatcgaggaaatcgagaattgaatttagataagtttgtgcgttatttatagattttatgtagcccaaattttcactgggctaaaatctccccttataattaaaaaataaatataactcatttttttaacaaggttaaaaactcttttctagtttctctgtcgtccaaaaatactccgccaaaagccgatgtcacagtgtaactattggtatctttaattccacggcattttacgcaaaaatgcgtagctttaacataaacggctacatcttccgtttctaaaatggtttggaatgccaacaaaatttgttgcgttagacgttcctgaacttgaggacgttgtgcaaaaaaagcaacaacacgattaattttagataaaccgatcacccatttttgcgggtaataagctactgacactttaccatcaatagttacaaaatgatgttcacaagtactggttaaagtcacatcatcaactagcaccatttcacttactttcatgcggttttcaatattagtaattttagggaaattagcgtaatctaaaccactaaaaatctcatcaataaacatttttgataaacgtgccggtgtttcctccaaactgtcatcagataaatctaaaccaatcagttttataacctcacgcatatgttgttcaataccttgacgacgttgatctttatcttgcataagatcaatcattggtgtttcaattcctttttcaaccaaagcattacgaaccttaatcgcttccggagataaattgctcatgactacttcccgtaaaatcgttatatcctttaaaaatgcctgacattctagcaaataaaagctgaaatctctatttattaggtataacaattactgaatttaaagtaaaatgtgagctgttttttcacattattacaaggatttctatgctatctcttgaacaagctttacagcaaatgctttcgcaattagcaactataaataaaactgaaacgctaacattggaacaagcagtggctcgcatttgtgcagaggatattatttcaccgattaatgtaccgtcttttgataattctgcaatggacggttatgcagtacgtttggcagatttgaaacattcaacaacgctatctatatgcgggaaatctttcgccggtaatccattcaacgagcaatggcaagaaaaaagtgttattcgaattatgaccggagcaatgcttcctgaaggtactgatgccgttgtaatgcaagaaaatgttacaataaacgaagacggcacagttactatcaatgaaatacctaaattgcaccaaaacattcgtcgtttaggagaagatataaaagtgggtgatattgcattaaaaatgggctcaaaattgaccgcactttcactcccgcttttagcctctttaggcatctctcacgtaaaagtttataagaaacccaaagttgctctattttcaacgggcgatgagcttgtatccgttggacagcctttagtacaaggaaaaatttacgatagcaatcgctttacaattcgattaatgctggaaaaatttccttgtgacatcttagattttggtattcttcccgatgatgaacaacttttcgagcaaactttttttaaggctcaaaaacaggctgatttagtgataagtagcggtggagtttctgttggagaggctgactttaccaaagctgtcttagaaaagtgcggtgaaattaatttctggaaaattgcaatgaaaccgggcaagccttttgctttcggtaaattaaataacgcttggttttgcggactgcccggcaatccggtttcagctttagtgacgttctatcaacttgtgcagcccgtaatagcaaaattaagtggctatacacaatggaaaatgccacaacaattaaaagcaatcagtgctacaaaattgaaaaaatctgttggtcggattgattttcagcgtggtttttaccaactcaatacacaagggcaaattgaagtttatcctgtcggacaacaaggttctcatctttttagtgcctttgtgaacagtaactgttttattcgtttggaacaagaacgtggaaatgtcgaagccggtagcatcgttactatagaaccttttagtgatattttaaactaggatctttatgcaaatcgaactctcaacaatagaagaattacgctataaccgtcaaattatcatgaaacaaattgattttgatggtcaagaaaagttaaaaggcacaaaaatgcttattgtcggcttgggaggattgggttgtgctgctgctcagtatcttgcttgcacaggtgtagggcatttaactctccttgattttgatactgtttctctctctaatttacaacgccaagtactgcataatgatgagcgtttaaatatgctgaaagtacaatctgctaaaatcgccctgcaacaactgaatcctcatattgaaattcaatgtattgcagaaaaattgaacgaagaaaaacttgctgaaattgtaccgcactttgatgcagtcttagactgtactgataatgtagaaattcgtaatcagctggatcgctgttgtttggctacaaaaacgcctttagtatcaggtgcggcaattcgtatggaagggcaagtttcggtgtttacttatgaagaaaatacaccaacttaccaacatttaagccgtctattcggtgaaaatacgctaagttgtgtggaagcaggtgttttatctccaatagtcggcattgtaggggcaattcaagccttggaagcaataaaagtgcggttaaatataggcaaaattttatcaggacgtttattgatgattgatggtttaaatatgaagatacgtgaaattaacattccgtctgaataaaaactcaatatccttacaatctctaagataatgctggattgcctaaaacacaggtttatcaatcaactgttttcaaagtagcaaagattcaggtagcacgccatcatctccacgatgtacccgcataccttcaacccgcacacgtcccgtcacacaatcagctatggcttttggtaacaaacggtgttctgcagctaaaactcgtgccgccaatgtttccggtgaatcatcatcggccacaggcacagccgcctgtgcgataatcggtccgcaatccatctctgccgttacaaaatgcaccgtacacccaactacacgacatcctgcttccaatgcccgacgatgcgtatccaacccagtgaatgcgggcaataacgatgggtgaatattaatcagcctcccagcataatgcgtgcaaaattctggcgtaagtatcctcataaagcctgctaaaacaacccaatcaggctgatattcatcgatttttctcatcaaagccgcatcaaaatcgctacgttcaggataatctttgtgactgaccacaccggtagcaataccttgttcttccgcccatgccaaaccagcagcatcagctttattagccaatactgccaccacatttgcaccctcaattcgagcttcaactacagcctgcatattactgccacgccctgaaattagaattacaatgttttgagtgttcatttttttccttcaatttttccttcaatcaacccagccgggattaattgctttgttgagatggcacaaacatcgttttaatcactgcaacttcagattccccctacattttatcaacccgttcgattcgaaaaagattcgaagtacgaacaacaaagatagtgaagaatatggattggggtagcccttaaaaggctatggctctatggctatggctatttgctattctccacccatttaccatcaacaaaataggcactccattttgttgttttaccatttttctctgaggtaacatattgacgtttttctttacgactaaagcgaataattgcctcattaccttcaggatctttaactggcgcatcagctaaatagcgtaatttttctggcaggcgatcttgatattgaaccaattcagccacttttgcaggacgactttctcgtgattttggaaaattatgtgctgacataaacacaccactcgccccatcacgcaatacaaaataagcatccgatttttcacattttaattcaggaaaatgtacaggatcctcttttggcggtgccacttccccacttttcaaaatcttccgagtattatcacaatttgtgcaacccatatatttaccgaaacgccctaattttaagtgcatttcggcaccgcacttatcacattcaactacaggaccttcatagcctttaattttatattcaccttgctcgaccaaatagccatcgcaatttggattattcccacaaatatgcaattttcttgtcgtatcaatcaaataactgtccattgcagtatcacatttcgaacaacgcttacgttccattaaggcttttgtttcagagctttcatctaaaacatttaataattccgcttccggaattaaatttattgtggttttgcaccgctctttgggcggtaaggcataaccggaacagcccaaaaaaacaccggtactggcagtacgaatagccatttggcggttacaagttgggcaacctatatctgttgcaaccaaactatttggtttcattcctccgtccaattcatccaattcagcttgtgttaattgttggctaaaatctttaaaaaattgatttaattcttctttccaatttttcttaccgtctgcaatttggtcaagtatattttccatattagcagtaaaatcataactcattaaatcagcaaacgattgattcaatcgatctgtgacaatttcccccattttttctgcataaaaacggcgattttcaactcgaacatagcccctttcttgaattgtggaaataattgctgcataagtagaaggacgaccaatccctcgtttttccaattctttaactaaggcagcttcactaaaacgtgctggtggtttggtgaaatattgttgaggttcaaccttagttaaacttaatttctctccaactttcactatcggcaactcttgatcttcagggtttctattcgattgaggtaatacttttgtccaaccatcaaagcgtaaaacacgtcctttggactttaactcataatctcctgattgtacggttacggttgtactgtcatatttagcggctggcatttgacaagcaacgaattgtcgccaaatcagatcatataaacgcactgcatctctttccattccctctaaactatctgccaattgtcttacatcagaaggacgaattgcttcatgtgcctcttgtgcattttcgttactggaatagaaattcggtttgtccggtaaataggcttgtccaaattcttgcacaatataattacgcaccatttctaaggcatctttacttaaatttgtgctatctgtacgcatataagtaatgtaacccgcttcatataaacgttgtgctaacatcatcgttttctttacgccaaaacctaattttgtgctggcactttgctgtaaagttgaagtaataaaaggtgcttttggttttgacgtcgttggttttatttcaagatctttgacgaaataatcggaaatttgtaaaaaatctaccgcacttctcgcctgttcgatatttttaggttcaaattttttcccttgaaattgtactacatctaaacgaataggtcgtttttgactgtttttactatcaacagaaatttcccaatattcttgaggttgaaaagccttaatttcacgctcacgctcaacgactaattttactgccacagattgaactcgaccggcagatagacctcgtgccacttttttccaaagtaatggtgataccataaaacctactacacgatctaaaaagcgacgagtctgttgtgcattaacacgatccaaatttaactgttcaggtttctcaaaagcttgtttaatcgcatttttagtaatctcattaaatactactcgactaaaacgactgtcttcgccgccaataacttcgcgtaaatgccaagctatcgcctctccttctctatccaaatcggtagcgagataaatatgatcaactttttttgctaaagatttgagttcagaaaccactttctctttaccgggtaaaatttgatacttagcttcccaattatgataaggatcaatccccattctttttaccaacgcattttgctctttttccgtttttatgcgttgtttttcttccgcacttaatcccttcgttgaaataggtttcgctttttcaccgctactttcacctaccgtaggcagatcacgaatatgccctacactggacttaactacatattgattacccaaatacttattaatagttttcgcttttgccggcgactcaacaattactaaggatttactcatatttttatttacctaattcgctgtatttttgtaaaattgcccgctatattgcttactatcttttgcaaggtcaacagttttttataaaaatgggtataaatgaataaactaaatgcagtttcaatcatctgtaaagttattaaaatatacagaacttttaaagctacaacgtaacaaagcatttaccccatcatgtttacgctaaactaaaagcattgattcattttgttatcagcttatatttgtactaaacgacacgctaaaaataaggtaagttaccttattttccctcacttccccagcgaagaaataaatcttgttctaattcaataccaaattgatcacatacacgattgacgctttggttaataatatcatctaagttactgggtttatggtaaaaagcgggcattagaggggtaatctgtgcacctatttctgccgcctgagtcatcaaacgtaaatgtcctaagtgtaaaggtgtttcacgtacacataataccaacggtttacgttcttttaagcatacatcagcagctcttgtcattaaatcatcggtatagctatgtgcaatacctgacagggtttttattgaacaaggcaaaattaccatgcctaaagtgcggtaagatccggaagaaattgccgcactaatgtcacgaatatcataaactttatcggacaattctcggacttgttgtaccgtaaattgtgtttcaagtgcaatagtctgtttcgccgcttggctaataataaggtgcgtttcaatttccggaagggattttaaaatttgcaacagccgaatagcataaatggcaccagatgcaccggtgatgccaataattaaacagtcttttttaagcttcattgtgcatttcgagattcgtggcatctttttcacgctttttctttgctttgtcattacgtaaatcggcaacttgatccaaatacgctgaggtaatatctccagtaacataaacaccggtaaagacagaacaatcaaaatctttaattgctggattttcttgctgaacagctctagttaaagcatcaagatcttggaatataagtttatccacaccaataagtttagcaatttcatgaacatctcgtccataagcaattaattcatttttagtaggcatatcaataccatacacatttggataacgaatttctggtgctgctgaggcaaaatagatcttatttgctcctgctgctcttgccatatcgacaatctgtttcgaagtcgtccctcgcacaatagagtcgtcaaccaacaacacattcttacctttaaattcagaagagatagtattgagcttacgacgtaccgcacttacacgctgagtttgccccggcataataaaggttcttcccacatagcgatttttcacaaaaccttgtcgataaggtttatttaaaatatgtgcaatttgtaacgcaatatcattggacgtttcaggaatgggaatcacaacatcaatatctaaatctttccactcttttgcaattttttgtcctaagttttctcccatgtgaacacgagccgcataaacggagacaccatcaatataagaatccggacgagcaaaataaacatattcaaagatacaaggtgttaacttaggactttcagcacattgttgtgcatataactgaccatcaaaagtaacataaacggcttctcccggtgctacatcacgaacaaattcaaagtcagcaatatctaacgcgatactttcagaagcaaacatatactctgttttaccgcttacctcatcttcacgttttcctaatactaacggacgaataccatttggatcacgaaatgcaactatgccataaccaatcatcattgcaacacaagcataagcaccacgaatatctttgtgagtagctctaactgcctcaaaaatatcctgcgtagataaagggtgtgttgtttgatccaaatgatgagccaaaatatttaacaaaatttccgaatccgaattggtattgacatgacggcgagcaaaggtaaagagtttttgttttaactcttctgaatttgttaaatttccgttatgcaccaaagttaaaccgtaaggtgaatttacataaaatggttgagcttcagagacactggaacttcctgcagtaggataacgcacatgaccaactcccgcattcccttgtaaacgtagcatgtgaacttgctgaaagacatcacttaccaatccatttgcttttcgtaagcgaaaacgattttcttcatctactgtgataatccctgccgcatcttgcccccgatgttgcaataccgtcaaggcattataaatagactgatttacagggctatggctaacaatacccacaattccgcacatatttcacgttccttatttattcaatgttgaatttattaaatttgaatttgcttgtatttgttcaaaaaaccattccacaataaagccaaagtgcggtattaattttgatgttttccaccaatcactctgtgcaaagtttgtgaaagaatcaataaaaaatagcaatgccgccacgattaatatacctcgtagcaacccaaagcaagcacctaataccctatctgttccggttaaacctgttttatcaactaactgactgataatgtagttaagcattgcaccaacaatcaaagttgctacaaataagattgcaatagcaaccgcattacgaacataaggtgcttctatttgagttaaataagttgctaaatagggataaaaattatttgccaccaaaaaagcaacaatccagctggcaagcgacataacttcacgcacaaaccctcgcaataaactgacaattatagagaataaaattattccgataatcattaaatcaagataattgttcattaggtaacctctaaaatcccatcaatttaagaccgcacttattctagcaaaaaaggaaaacgtttgcgtagtctaaattcacgctttatgcaaatttaatcgaaataaaaaagaagaaatcagaattgtcgtctaaaaatatagatggaaatatcaggaaatgtatcctttcagtttaaaatccatctgtctattcactaaaacactagatgagagatgttgagttagtcgataagccgggttctgtcttggacaatcattcatctaggcgtatatttacacatacgctcaagcaacctacccgaactctgagcgggcaactcattgagttcctatttggtcttgctacgagtggagtttaccatgccataaaatgttaccattcatgcggtgtgctcttaccacaccctttcacccttacctgatctcttacgagccattggcggtctgctctctgttgcactggtcgtaggctcacgcctcccggacgttatccggcactctgccctatgtagcccggactttcctctcgtttacttatgcctctaagtcgtttaaaaacggttaaagatttcaacaaaccagcgattgcctgactaactcgatgcggagtatagcgtaaaattcagataaaatatagagttcacccaaaacttgcggtaaaataaccgcacttttcaatgaggaaatgacgatgaattacttacaaatcgctcgaaattcgttagctgccgagcaaaatgctttagccaaacttagtcaaaatttaaatcaacagtttaatcaggttgttgagcttattttaaattgtgaagggcgattagttgttggcggaatcgggaaatccggacttattggtaaaaaaatggttgctacatttgcctcaacaggaacaccaagtttttttctacatccaacagaggcttttcatggtgatttaggtatgttaaagcctattgacattgtgatgttaatctcttacagcggtgaaagtgacgatgttaataaattgattcccagcttaaaaaattttggcaataaaatcattgcattaacaggtaacctaaattctactttagcaaaacatgccgactatatccttgatattagtgttgagcgtgaagcttgtcccaataatctggctccaacaacttcggctttagtaacgttagctttaggcgacgctcttgcggtttctttaattacagccagaaactttcaaccggctgattttgccaaatttcatccaggcggtagtcttggtcgtcgtttgttatgtagagtgaaagatcaaatgcaagttcgtttaccaaaagtaacagaaaacacaaactttactgattgtttaaccgttatgaatgaaggtcgtatgggggttgctcttgtcatggaaaatgaaaatttaaaaggtattattaccgatggtgatattcgccgtgcattaagtgcaaacggaactaatacacttaacaaaacagccaaagatcttatgacttccaatcctaaaactattaactataatacttatctgtctgaagcggaaaactttatgaaagagaaaaaaattcattcattagtcgttgtagatgatcagaataaagtgataggtttagttgaattttcgagttaatcccatgatgttattaaatgaaaaattacaaaaaattaagctggttattaccgatattgatggtgtactaacagacggcttattgcattatgatgccaacggggaagtaatgaaaagtttccatgtgcgtgatggactgggtatctgtatgttaatcaaaaatggcattcaagttgcagtcttatctggtcgagactcccctatcttacgtaaacgcattgcagacttaggcatcaatttatttttcttaggtaaattagaaaaagagagtgcttgttttgaattaatcaaaaaagcaggtgtaacacccgaagaaactgcgtacattggtgatgatagcgttgatttacccgcattttccgtttgcggattgtcttttgccgtaaatgatgcgatggactatgtgaaagattgtgctgatcatattttgagtttacccggagggaaaggtgcctttcgagaagtgtctgatatgattttaaaagctcaaggaaaagcaagtgtctattccacagcacaaggtattctcaaagcagttaacaagatggtgcaataaaatagataatgaaaataacagtccacatacaaaataagcggactgttacttgtctgtaaaatatctctaaacacaactaaaatccccgcaagcaacgtaaaaaatacttttcacattctacccattcattcattaatttaataaccacattatcgatcaccgcacttacataagctaaaccttacatcataattgcctattcgtattctaaataacaatagttattattaaaaatacccttttaaattaataacttataaaaaaataaaagttgcattccatgaaaaactgattaaaataaaacctgttttattcatcaataaaaaaggaactcgctatgctaaatcaagctattattactaagttaaatgaacaaattaacttagagttttattcatctaatgtatatttacagatgagttcatggtgtgctcataacggctatgaaggtgcagctgcatttttacttcgacatgcagatgaagaaatgcaacatatgcataaattattcacttatgtaagtgaaacaagtggtatgcctctgttaggtaaaattgaagcacccaaaaatgattacaaatctttaaaagaaatttttgaaataatcttagaacacgaaaaatttgtaactagtaaaatcaatgaattagttgaaattacttttgcaaccaaagactattcaacatttaacttcttacaatggtatgttgcggaacaacatgaagaagaaaaattatttaccggcattattgataaattcaatttgatgggcgaagacggtcgttctctttactttatcgatcgtgatttacttactttataatagataggacaaaaatatgttatcagcaaatgttatcaaattattaaatgatcaaatgaatttagaattttattcttctaacctgtatttacaaatgagtgcttggtgtgagcaaaacggttttgacggaacagctaaatttttagccacacatgcagtagaagaaatgcaacatatgcgtaagttattcacttatttgaatgaaacaggtgcttcggcaatcattacggctattgatgaaccgccacatgaatttgattcattaaaacaagtaattgaactaacatacgaacatgaaaaactcattacctgcaaaatcaatgaattagtcggaaaaacctttgaagagaaagattattcagctttcaatttcttacaatggtatgtagcagagcaacatgaagaagagaagttatttagtggtattttagataaaattaatcttcttggtgaagatggtaaatgtttatatctaatagataaagacctaggtgatttgacaagtaaagtataatctatagaaaagcaaatctaatctgacagtccctgtttaaaattatcatatctgtcagattagtttgagcttaagttttttctatctaagtacattttccatcaagtgatgttgctattaatctctcacttaagcacgtttttgtgggattataataaagctctctttttgagttactatgccttttaccaaaatgagtaaaaaaataatcatttgtagaatcatactaatgacagtttaaagatatcacttgatagtaattgacaatattcagtagacagtcctttatctgtgataatttgtgtaaagttattaagttgagttgcacaaaataaggaatattttccatatttactgctatcggcaactaatactttttgtttggcattttgttggagcattctttttaaatgagctttctcttctgtaggtgcggtaacacctttttccaaactccaagaattacaacttacaaaagcaatatcaggattaatgttattcaataaagtcaggctatggttaccgatacaggattggctactattatccactcttcccccagttatggtcaattctatttgtttatattcggaaagtaacaaagcgatatgcagatcagtcgtaatcactcgaagtggcatatgagcgattttttttgcaatgcacaaagttgtagtgcctgcatctaatacaatagagtctcccggagaaatgagagaaacagcatattcggctatccgctctttttcagtaatttgcttaagttgcttttcatttgtagttggttggaatggaataaagtggtttaagcttactcctccgtgtgtacgaattacaacaccttcttcatctaattttattaaatcacggcggatagttgcaggagaagcctcagtaacctttaccagctgttctacggtagcaatattatgactttttagaaatagtaaaatctgctctagacgatttttagacatataaactctcttatttgtaattattttactataaataattttttgaaaataagatagtgaaaattaaagaacctaaaacattattgctttaggttctttagtattatttctccattatgtggcttaaaagtacttcgcttccaaatccaccggatttggtcattacaacgatgtctgaatagttaccttcttcaattaagcataaaggcactcccggtactactgcatataatacgttcatttcagttacattcatttgatccaataatgctgcagccccatctccaccgaatagtataagactatcaaatttttcattatcaaggcagaatttacttaaatcagctaagtgttgagaaatttctttagcggtttcagtaatatttgccgattttgcatttacgacttttgctgggtttgctcgaataatcacattatccttactaaaacgtattagagcgtttaattgtagttttagtgaatgttctgactgtgaatagttcatcaactgcgaaggtgaaggatgaaatacaatcgattttccacctaaagttgaaacatattcatcaacttgaagctggcttgtttcgtggattgatgttactacaattaatgttctacctaatgtaatctctcgctttggtctcggtttattttgaatatttttcaatttctgtgctaatccagctgagccaacaggaataattttatttcctatatggtttataacttttgcaataattgcaagatcttcgtgcgttttagcatcaataacgatctgtttatattcactattttcaatagatgcctgcaaattatcgaccgtatcacacggaattacttgagcatcaggcaataattcttgcatagaggaagacagtacagggcaaataggatctttgcctgaagcagtttcctttacaggaacactattaacatataaatgaccagcttctatcgttctccccatttctggatatgcaggacaaataattgctttaacgtctggatataaactagcccaagcttcaatagcaccttcaatttgatattttacagagcctctcattgtagaatcaattttgaggtaaatttgcccaataccattttggatagcattactaattgcaatttgagtttgttcttttgccttttctccaatagctcttgagtcagtagaaacagaaattacttgagctttatcagattgcatttgtgctaatgccgaaactttagtttttaagacagtgttaaaccctgcttcagcaaacataactgcggtatcatttgcaccggtaagatcatctgcaataactaagagagtttctttcatagcttttccccttttactgtttcttgtgctaatccaccttgacgttttaaaacccaagccgcaaataatggagctaaaacagcggaaactaatacagcagctgcaatttgtgcagtagcagtttgcacaaaaggtgctagtgtaggatctgcttgagcaacaatttcaggtgtaattatggcatttccagcagtagtaccagcagcaaatccaatccctgattgattacctcgtcttaaaatagttttgtaaccgataaacacaaggaaacctgtaaagagagaagctactatacctaaaataatacctgttgctccaccagtaataatggcttgtaagttaatacctgtacctaatgcgaaagcaaagaaagggataacaatagcaccagttggtttcattagttctgtccatttaggatctaagttaccaataaccataccaacaatcagaggaataacagctgcaagcatcaatgagaaaagaatatcagctaatcccgatacacctaaaaatagtaaaacaaagaaaggaccgtcattaactgcagaagcaatataagcccctttatctctataatcgccatattttcctgtaaatgccaaccaaatacccccatttgagttagccacaacagtaagcatagctaataaagaaacacccataacaccatcatttcccacccataatcctaaaaaaacaactaaaagagcgggtataattgttttaaataataatacaatgccggtatgagcaagaacaggaccggaacttctcacagtaatttgcataccagttgcgaaaattaagagtgcaataagtgggccagctgatgatttgaataaagctgtcgtaaatgaacctaaattcaaacagtcaggcaaaaacgtaccaataatagaaccaaaaattagtggtattaccattgccccaccgggaattttattcataccatcatatattggaacgatggatttagatacttgagtagacatattaatctccttagtgtgttgcatatttgatgtttgccatttttgcccccaaatagagtgcttcagtcatactacggctatcggcaactccctttcctgcaatcggaaaagcagtaccatggtcgacagatgttcgaataaatggaagaccgacagtaacatttacacctgtatcaaaacctaataatttgatagggatatgtccttgatcgtggtacatcacgacgacaatatcgaactcgtttagattagctgcacgatgaaataaagtatccggtggtacaggtcctgtaacattaaatcctttagcttgagctgctagaattgcaggtacgatttctttttgatcttcatcaccaaacattccattttcaccagaatgagggtttaaaccagcaacagcaatacgaggctctttaaaaccaagaatacgagcattttcttctgccaaatcaataacagtggcaactcgttctttagtaactaaatcacaagctttacgaagttggacgtgagtagtaacgtgaataacgttgagtttttcgctggttagcatcattgagtaatctttagtattactaagggtagctaaaatttcagtatgaccgggaaacattttactacttgcatgtaatgcctctttatttaaaggggctgtaacaatagcttggattttcccttccattgctaacttaacggctttttcgatgtattcataagccgctttaccagcacgaggatcaatttgagcaaaaggcaaatcttctggtaggttattcaaatctaaaatatcaataacaccatactctgccgtaaagctatctagatcatttagtattcttaatttcagttctgaatgaacaataggtaaagctcgttgcataatttttcgatcgccgataacaactgggtgtgctaactcataaatccgtttatcagccaatgctttaataataacttctgggccgatacctgcggcatctcccatcgtaattcctaaaataggtttcattttcactccttgattgaaattaatcaattttagcaaattatatcgcaaataaagagataaaaatgtgattaaagtcaaaaaatgatcttttttaatcatatagattttatttaatctaatggtaaggattataaagcagattagaaaagtaaaatgttatttaatttgaataaacacttccctttttagcaaaaaacggtatcattacgcctcttaaatgtaaccctacatttaagtttgtttccaacctatcctatcttgggacaaatagggtaaaaacaaaaaagctggaacgctttttttaataagtagcgagtcaaatgccccatggcgtctagtctctcgggatttgagagcttaggcttcctccgcaaggcacccgacttatttttttcacctcttttagaaggtttatttcaatgacaattaaaacccctgttcaagcaactcttgcttcaaatcaatactttttagatcgccaagatataatggaatcaaacgtgcgtagttacccgcgtaaactgccgtttgcttatcaaaaagcacagggcgtttgggtaactgatgttgaaggtaatgaatacctcgatttcttagctggtgcaggaacgcttgcattaggtcataatcaccctaaattaattcaagcaattaaagatgttttagacagcggtttgccgttacattctttagatattaccaccccattaaaagatgcttttaccgaagaattactctctttcttccctaaggataaatacatcttacaatttaccggtccatcaggagcagatgctaatgaagcggcaataaaattagcgaaaacctatacaggtcgtggcaatgtcattgcattctctggaggtttccatggtatgacacacggtgcattatctttaaccggtaacttaggtgcaaaaaatgctgtgcaaggtttaatgcctggtgtgcaattcatgccttatccacacgaataccgttgcccatttggtattggcggtgaggctggtgtgaaagcggttgaacattattttgaaaactttattgaagatgttgaaagtggtgtagtaaaaccagcggcggtgattttggaagctattcaaggtgagggcggtgttgttccggctccaatcagcttcttacaaaaagtacgtgaagtaacccaaaaacacggcattttaatgattgtggatgaagtacaagctggtttctgtcgttcaggaaaaatgtttgcctttgaacatgcaaatattgaaccagacattgtagtaatgtcaaaagcaattggtggtagccttcctttagcagttttagctatcaaaaaagaatttgatgcatggcaaccggcaggacatacaggcacattccgtggcaaccaattagcgatggcaacaggctatgtttctctcaaaattatgcgtgaagaaaacttggctcagaacgcaaaagagcggggtgaatacttaactaaagccttaactgaattaagcaaagagtttccttgtatcgggaatgtgcgaggtaaggggttaatgatgggtattgacattgtggacgaacaccaagccaaagatgcaacaggtgcttacccacgtgattgcgatttagcggtagctattcaaaaatattgttttaaaaacaaattgttactagagcgtggtggtcgtggtggaaatgtggtacgtattttatgtgcggtaaacattacccaagcagaatgcgaggaatttattaaacgctttaagcaatctgtaggcgaagctgtgaaagcggtacgtggttaatttttgataaaacaagcggtcatattttgcaaaaaatttgcgaattttgaccgcttgaattgtatatagcattgaatgagataacaaaaatgacagatatttccaaacacagacaatcgctattttgtagcgatccacaatctattgcggattatgaaaccgcaatgaacaatgcggtacaagcggtatcaaattggctaaaaaatgaaaaaatgtacaccggcggttcgatcaagcaaatgcgagccttgattgacggcttcaagccgaccaaagagggcgtgggagtgcaaaaatctcttgagcatttggtagagattttcctcaacccaagccttaaagttcaccatccacactctttagctcacttacattgcccgacaatggtgaccagccaaattgcagaagtgttaattaatgcgactaaccaatctatggactcttgggatcaaagccctgcgggatctattatggaagagcatttaatcgactggttacgccaaaaagtcggctatggtgaaggtacagctggggtgtttacttcaggtggtacgcagtcgaatttaatgggcgtattgttagctcgtgactgggcgattgcgaaccgttggaaaaatgaagacggctctgaatggtcggtgcaagcgaatggtattcctgctgaggcaatgaaaaacgtgaaagtgatttgctcggaaaatgcccacttttcggtacaaaaaaatatggcgatgatgggaatgggcttccaatcggtagtcactgtgccgtcaaatgccaatgctcaaatggacttagaagcgttagccaaaaccttagcagacttaaaagctgatggtaaaatcgtagcttgtattgtagcaactgcaggcacaaccgatgctggtgcgattgatgatttaaaagcaatccgcaaattggcggacgaataccaagcgtggttacacgttgatgctgcttggggaggtgctttattattatcgaaagatttccgtcatttcttagatggaattgaactaaccgactcgattacacttgacttccacaaacatttcttccaatccatttcttgtggggcattcttgttaaaagacgaggtgaattatcgtttcattgattacaaggcagattacctcaactcagaatatgacgaagaacatggtgtaccaaacttagtagcaaaatcactgcaaacaactcgccgttttgatgcgttaaaattatggtttacggtagaagctttgggtgaaaatctgtatgcttcaatgattgatcacggtgtgtatttatcaaaagaggttgaggcttacattactgctaccgaaggcttggaaatgttagtacctgcacaatttgcctcagtgctgttccgtgttgtgccgaaaggctatccggcagaatttgtggatacattgaaccaaaacgtggctgatgagctgtttgctcgtggtgaagcgaatattggtgtcacgaaagtcggtaacaagcaatcactgaaaatgacaaccttaagcccgattgctactcttgaaaatgtgaaagccttattagcacaagtgttggcagaatcagaacgcatcaaagattctattgtaaacggcacctatatcccgcctattgattaaacgattggcaaaattatacctaaatcagaccgcttatcagccttgaattgattaatgagcggtcaattttttaactttttacaaattttattgaaagctctattgttcataacaagttaatcaaccattaatttcctcaatacttcacccaacccactttgacgctcagtcgctttactcaccgccatattccatactttgcggtcagaaaaaacagtaacttgattgattgctcttgttactcctgtataaaccaattctttacataaaacaggattggcttcacaaggcaaaaccacaaaggtatgagaaaattctgaaccttgggatttatgaatagtcatggcaaatgccggactatgatcaggaatacgacttgctaattcagccttaccattttcaaaccaaaaatgcccttttaagctaccatcaggttgtttttctgctaaatacaacgcaatatcaccattagccaatccgagacggctattattttcagtaataatgattggttttccaatatagaaatcacgactatgattaaattgcacaagtccttttttctttaattgttctgcaataagttgattgagattttcgctccccaattctcctaccctaagtgcggtcaaaaatctcactttattgaatgcggcaaaaatagccgcaatatgcagtttaatcggtaagttattttcagtaattttgtgaataagttgcaaatattcttcataattttgcaccgcactttgcacgaccaattgactgcaatattgagaataatggtgtgctaatggctgttcatcaatattagtttgttcatattgtgtagaataatccactaaattgatttctcccgtgtcgtttgtgttattttcttgttgatattgatgaaataattgccaactttcagcaattttttgttggttaattaattgagctaatttaccaatataaggatgtttaccgaaacgacgactgccctctaagttgcataaacaatcacgaataagattttcatctgcatgatgttctaagttttcccctgttgtttgctgtaaataacttgctaacgttgaactaattgaatattgtctaaaagtacctaattcagccaaaatcgctcctgcttcaacagaagataactgatccttatcgccaagcaaaatcagcttacaactcggtttcaaggcttgtaataatttcgccattagaaacaaatccaccatagatgcttcatccactaccaagagatctatcggtagtggattacgtttattatatttcgtcttttcttcaaaaaatcgcacaccaattaaactatgaatagtttcagcattaaaaggaatagcattttttatatgttcactaactttaattaactccttttttgtcaataaattaaaggaatttttcatactaatttttaagcgttctgaagcttttccagttggggcaactaggcgaataactaattttccctctgccaactcctgtaatgccaataataatcgagtaactgttgtcgttttacctgttccaggtccacctgtaatcatgcaaaaaggttgatgaattgccgttgctacagcaattttctgccaattatgcttttgttttaaactattatcttcatgatctaccgggaagtatttttgtaagatgccttgaattttttctatcggatatggttgattttctttctgttttattgttcgaattaaaaattcggcaattcgatgctcatcttgccatgtgcgataaaaatataggcgattattttgtagcaccaagggctttacctcattaataggatcttgagtaaatgcgatatgattaatgagtaaattttgccattcagattgtgtaatattccctattttctctcttatatcaataaggtaacttttttccgcataaggtaaattaaacagatttctaaaagaaaaattttctaattttaagcacgtatgtccttgttgattatgaaaattacaaagtgcggcaagtaaaatagctaaatttttaacttgtgatgaataatctaattcccgttgtttatctgcaatcaactttgcaaaataataatcaccagcttgaataaatttcctttccttaagttgatacaaaatatttagcattaaaataaactctccaattcagaaatcaaacgccaatccggtttatcaaaaaatatcccggaattatcttttccattcattccacgtaaaaaagtataaagtacaccgccgaaatcacgttggtaatcataatttttatcccgctcttttaaataacgatgtaatgcaatggtataaattaaatactgccaatcataatgattattacacatcacttgaattagattgtcttgctgataatgttgagaagaatagcctagtaaattagacttataatctaataagtaatacttgccttcaaaacgaacgaccaaatcaataaaacctctcaccatacctttaattctatccatcagtatcggtgatgacggtaaacgatgatacttacttaacagccgattaaagacattttcattaaatgattgatttaatttcaaataaaattgcatttcttttaaacaatcttgtggcttgatattgcctaaagtaaagcctgcaatatcctgttttaaaggcgtattaaaaatcgcatttatccattttttcaatggattttgccattcatcacttaattgtaacgcctgacaaagtttagataattggtcatcattcaatgcctgcgtcatattatatttttcaaaataacgatggaattcgctaccaacatggacaccatgaggaaaatcaaacggtgaaaaacctacaggataatcagaatctgcactcaactttatatcaaatgactctgacatatcatgaccattttctctcacatcatgatctcttgcttgatcaaaaactccggatatttcaatctgctgtgctttttgtcgagaatttaaagatctgttacgttgatgacggtaggtcatttcagtaaaacttgttacagtccaattacgctcaatcttgccatgaaattcttccgcttcaactagcgacaatgcctgttgcactgtaatatactcatttctccttactaataattttttatcttcctctatttcaatacattgttcgcctaattcctcaattattggacttaacaatttttttgcatcatatgcatcattaattcttttatttacaccaatttgtcccttagttaatacataaagtaacgcattccattttttctcaaaaacgcgaggaagattaataacaatctgatatttcgctcgagtaagtgcaacatagagtaaacggatatcttccgccatacgctctttttcaatttcatcggaatgttgcttatccatatcccataacacttgttcttgattttcatcataataagtattaatggcattatctcggaatagggacggcttacaaataaaaggaatccaaactaaatcataagcaagccctttggatttatgtaatgtaacaatcttgactaattctcgatcactttctaaccgaatttgttcttccaagcgttcttcgccttgaatctgtttctcaaaccaacgaactaaggaggactcggtatcatttaaacgggtagcctgttgcaataactcacttaaatgccacaaatcagtcatttttctctcaccttgttccatcatttgtaaattttcattaattttttcaactgcaaataaatgatgcaacataggtaaaataccctgcctttgccattgttgttggtaagcaataaatcgctcaacacagttttcccataagttctcatcttgcttaatttggaatatttctgcaccggttttagcaaaaagagcggtactcaacgcatttaaaatattattttcatttaacggatttaaacaagctcgtaaaatatgcaacagttcttttgcagtgatactatcaaaaacgttactacgatctgaaagataaactgatgcaatacctttatcccttaaggctttttgtattttctccgcttgagtaaaactactgactaaaactgcaatattttttgcttttagtggtttgttatctaaaatagcttgattttgtaccgcactttgtagccattgctcaatagataaagcacaattttcagcaagttgtgtgtcattgttgtcagtcaaataacctcttaatgcaggttcaattctcccatttaagcaaaatcggttgggaagaagatttccttgagtgtcataatataatcctttagcaacctgttgaaatggaatttttttatgtaaaaaaggagaattttcttgaaaatcaaaaagataatttatcgtctgaataagaggttgtgtagaacgccaattttcgcccaaactaaatcgatattgtgcttgttccgttgctttcagataggtaaaaatatccgcaccacgaaatttataaatagattgtttaggatccccaatcataataaagcccgtatttttcaccgcacttttaatataaatttgataaaaaatatcatattgctgttgatctgtatcctgaaactcatcaatcatagcaaaaggatattgatggcgaataagttgtgctaatttatctccttgtggttgatataaagcattgcgtaccagacgtaaaagatcatcaaaccccttttgttgatgcgtaagtttataatccattattttacgatttaattcatgaacacaatggtataaaagtacagaaaaattatttgaaatttgagtaacttcattggtcactaagttttccaattcggaaaataaatcatgcgatactaaaggttcttttttatctaattccaattgataaaaatattttgccgcctcaggttgctgaatatcctcgttttctgcccatactcgcattttattaaaacgactttcaaaccaatctttacgccatttttttaaagcgacaagctctcttaacgctttttcattttctaaccaacgttgtttaaattgatgaattttactaagttgaggctcaacttgagtatgtaaaaattgctgcagagaaatctccaataagtgcggtttttgggtatttacttttggcggctgagaaagatatttataaacgtaagataccagttgcttcggcgatcctaattttttgaaaatgaagtttgcgactgacaaaggctgatgataaaaattttcacgccatagctcatttgccaaacgttgaattagttcagattcatcactcaccagttccatattaaaatgtacccccgaattaaaggcatattgcattaatactcggcgacaaaaactatgaatagtcgaaacggcggaaatatccaaatttcgctctgctaaagttaaacgatagactgcaagatcgatgtctttaatataaggcagtaattcttgcagaaattgatcttcaagtaatgttttattttgatgttgctgatattgaattaacgcttgttttgtttgataaatacgttcccgaatacgttgctttaactcttgtgttgccatttctgtataagttactaccaaaatttgatcaacttccaatgcctgagaaaaattattttctcccgcttgtaataacaagcgaatataaagagaaacgatggaatgagtttttcctgtaccggcagatgcctcaattaaactgaccgcacttaacggagtagaaataggattaaaaggttgaaagacggatatgcgtaaggaagaatattgatcttgtaagctggtcatgaaattaagcatcttcgatagaacatagaatattgactaatttacctaacctaaactctttttgcaaaccttcaaaccgatgtaaaaataaaacggagcagatcttccgctccgttctcatgttatttgccattcaaactatctaaattacgtaatgcttcaatacgtttttccaatggaggatgacttaagaataaagaagcaagtcctccacgttttccattgatggcaaaagcggctagctgcccctccatttcttgtggctcatgcaacgttttcaaacgttgtaacgctgcaatcattttatgtttacccactaattccgctgaacctgcatcagctttaaattcacgatagcgagaaaaccacattgcaatcatacttgccaatacaccaaacacaagctcaagaaccattgaaatcataaaatatataccttgactggtatttccatcacgatctgtagcaacaacttttgccagcattcgagaaataaaaatgacgaacgtatttaatacgccttgcaacaaagtcatcgttaccatatcaccgcttttaatatggcttacttcgtgagctaaaaccgcttccgcctcatctcttgtcatagcatttagtaatcctgtactcacggcaacaagtgaattcttttttgtcgcacctgttgcaaaagcatttacatccgctgaatgataaatggcaactgtcggcataggtaatcctgctctttctgcctgtgaatgcaccgtttgaagcaaccaatgttccgtttcattacgaggttgttcaataacttgaccatttaccgaacgtaatgccattgattttgacatcagtaaagaaataaccgatcccgtaaaaccaaataaagtagcaaaaatcaacaatcccaccgcatcttggcgttgaataccggtcaacgtcaaaataatgttaaaaacaaataaaacggcaaagttagttgctaaaaatagcaaaattctcatcataataaagttcctttacattaaaaattctctgcctatgataaggacaaaatattgaaactcaagggtaaaataaaaaaatttgttaccataaactcatttgtttttgctcaattattgtgggaatactgacatataatccaactaaacgcacagaacgattttgatgtcgttgccaaatttgagttaatagttttacaaaattttcttgcgaacatttcaccgcacttttttctaatgttgttatttggaagtcataaaattttaatttcacgcctattttacaaaaacgttctaagggaatagcaggacaagtctttttaattcgtttcaataaaagaggataaaggctattgataacctcaataccttgttcaacttgcaaaatatttttcattaaagttcgttccagcccgatagatttaggttcacgatgagactgcacagggcgttcatctataccttgactaaattgccaaatacgatgtcctattttaccaaatcgatcgattaaaacatgatagtcaaattgttgaatatccgaacaagtttctaatcccatttgctgtaatcgttgcgttgtcacttttccaactcccggaatttttttcagtggaagttgcctaataaacgttgcaacttcttcaggcttaataacaaactgtccattgggcttattctgatctgaagcaattttagccaaaaattttaacggagcaataccggcagatgccgttaatcccgtttcctgagtaatgatttgtctaatttcttctgcaatccacgttgctgagcctgaacatttttgacaatccgttacatccaaataagcctcatctaaagacaaaggttcaattaaatccgtataacgcaaaaaaatgtgttggatttgttgcgaaacctgcttatataaaggcatatttacagctaataataccaaatcgggacaaagtttcagtgcttgcgatgttggcattgcactatgtaagccaaactgacgagcaacataattacaagtacttaataccccacgctgattagccaatccgcccacagcaacaggtctatcatacaattccggtttatctcttatttcaatagatgcataaaagcaatccatatcaatatgaataattttacgaaacatcattgttaaaagtgcgattaaaatgttcaaatttgaccgtattctaacatttttactgtataaataaacagtttttgttgtttttcttatttaacatcatttatacctatttttctccaagtaatgtcttttagttatgtttttttgaaagctgtacattttatcctccttctttccgatacggtcctaccagctaaaatttttgacaaaatcactgatttttttgcaaaaaaggcatagaatacaggacgcatttgcaccttaataaaaatgttattaaaatgcggtgttattttgtgctaaaccatttttaggaaaatcagatgagccaagaatttttggattttgaactgcctatcgctgaattagaagcgaaaattgaggctttacgttcagtttcacaacaagatcaacagattaatttagatgatgaaattactcgtttacaaaagaaaagtgcggagctaacgcaaaaaacttttgctaatttagatgcttggcaggtatctcaaatggctcgccaccctaatcgtccttatactttagactatattgaacatatttttacagattttcaaacactggcaggcgatcgtgcttttgctgatgatcaagcaattgtcggtggattggctcgtctagaggaacgtcccgttatgattatcggtcatcaaaaaggacgtagcattaaagaaaaagtaaaacgtaactttggtatgcccgcacctgaaggttatcgcaaagcattacgtttaatgcaaatggcggaacgattcaagttgccaatcattactttcatcgacacgccgggggcttatccgggggtcggtgcagaagaaagaggtcaatctgaagctattgcacgtaatttacgtgaaatgtctatgttaaaagtaccgatcatttgtacagtaattggtgagggcggctcgggaggtgcgcttgctatcggtgttggtgataaaatcaatatgctgcaatacagtacttactccgttatttctccggaaggctgtgcctcgattttatggaaaagtgcagcaaaagcctctacagcagcagaagtaatgggcttaacagcttctcgtttgcacgaattaaaactgattgatagcataattgaagaacccttaggaggtgcacatcgcaactatgacactatgtcaaataatctgaaaaaacgtttgttagccgatcttgccgacttggataaattagatcaagagactttattagatcgccgttacaaacgattaatgagctatggttattgctaattttataaaaatagggcggtcttataccgctcttttctatttatagatatgttatataggaagaaaaaatgaaaaatattctctcaattcaatctcacgttgtttatggctatgcaggcaataaatcagcaacatttccgatgcagttgctaggcattgatgtttgggcgttaaatacagtgcaattttctaaccatacacaatatggaaaatggaccggcatggtcattcccaaagaacaaattggtgaaattgtacaaggtattgataatattggagaacttcatcaatgtgatgctgtcctgtccggttatatcggctcagcagaacaagtagaagaaattataaaagcctttcataaagtaaaagaacgtaatccaaaagcaatttatttgtgcgatccggtgatgggacatcctgataaaggctgtgttgttgcagatggtgttaaagaaggactgattaaaattgcgatggctcaggcagatattattaccccaaatttagttgaactaagagaattaagcggattagcggttgaaaattttgaacaggctattgaagcagtaaaagtgattctaagtaaaggtccgaaaaaagtattggttaaacatttaagtcgtgttggtaagaatgctgcacaatttgaaatgttattggcaaataatgatggtatttggcatatcagtcgcccattacataatttcaataaagaacctgttggcgtaggtgatttaaccgccggattattccttgcaaacctactgaatggaaaatcggatattgaagcatttgaacatactgcaaatacagtaaatgacgtaatggaaacaacacataatgcaggcgtctatgaacttcaaactattgctgctcgtgaatggattgttaatccgaaaagccaatataaagcagtaaaaataggttaatcttattaaattgtaggggttattactcctacttttaatatttccaagctcaatagatttcgatcggaatccctatggatttattacaacagttacaaaatcagttaaatcagtttccctctcatactaaacttctactaggatttagtggcggactggactcaacggttttgttatctttattggcaaaactcagaaaaaaacaaccgcacttatccttacgggcaatccatattcatcacggattaagtcaaaatgcagataactgggctattcattgccgacaaatttgtcagcaactggatatttcttttctgtgtgaaaaggtgacaattaatcctcgtaaaggaattgaggctgatgctcgtgaagcccgttatcaagcgattgctaatcatctacaagacaacgaaattcttgttaccgctcatcatcaacaagatcaaacagaaacctttttgttagctttaaaacgtggcagtggcttacagggattgggggcaatgcaaatacagagtgttgtttttaatctgcctatttttcgcccgcttttacattgcacaagacaacaacttgagcaatatgctaaaacagaaaaacttagctggattgaagatgaaagtaatgctgataatcgttatgaacgtaactttttacgtaacgatattttgcctaaacttcgtcagcgttggcaatctattgataatgcggtacaacgtagtgctcaacattgctttgaacagcagcaactgattaatgaattgcttaatgatgaatttaataaaatttacgataaattcgaccgcactttatccattgccaatttcgctacttactcaattttaaagcaaaaagccttactacgaacttggttacaacatctccatattttgatgccttcaacaatacagttggataatattatgagaaatatgattcaagcacaagaggatcgtaatccgacatgtagacttggaaatcaggtcttacgccgttatcaaaaacgtctttatgctacgccgatattacaagatttaagtcatattcgcctagatattcaagctaacgaatgcattaatttaccggataatttaggtgaaatttgtttactaaccaaaaatgagcatttgcaggttacatggcaaaataaacagattttattacccctgacacaggaaaaaatagaaattcgctttcgctattccggtaaagttaaactcccgcaaggatttcatcaagaaatgaaaaaatgttggcaagatcataatgttcccatatggcaacgcactcgtattcccttgattttttatggcaataaatttaaaagtgcggtaggtttttttaataattgtgagtaaaaaaataaccccatcttgatggggctattttaagaaccaatcctatcttaacgccaacttttaaactgattaattaaaccattagttgaactgtcgtgactattgatttgctcatctccaaccagttctggcaaaatgcggttagcaagttgtttacctaattcaactccccattgatcaaaactgtaaatattaaaaattaccccttgtacaaaaattttatgttcgtacatagcaattaatgcacctaacgtgaatggcgtaattttttgcactaaaatgctgtttgtcggtttattaccggtaaaaattttaaacggtacaatatttttcacttcatctaaggactttcctgcttgaataaattcagcttcaacttcttgttgtgttttaccaaaagcgagtgcttctgtttgtgcaaagaaatttgaaagcaatttattatgatgatctgacaacacattatgggtttgtgctggggcaataaaatcacaaggaataatcttcgtcccttgatgaattaattgatagaatgcgtgctgaccgttagtgccaggttctccccaaataataggaccagtttgataattattaatcacttgaccactgcgatctacatatttaccgttagattccatattaccctgttggaaataagctgcaaaacgatgtaaatattggtcataaggtaacatcgcttcagtttcagcacctaagaaattacagttccaaataccaattaacgctaacgtaatcggaatattttgttccattggtgcggtgcggaaatgtttatccatttcatgtgcaccagctaatagttgctcaaaattgtcaaacccaatagaaagtgcaatagaaagtccgattgcagaccataaagaataacgaccgcctacccaatcccaaaattcaaacatattgtgagtatctataccaaacttctccacttcttttacattggttgaaagtgcagcgaaatgcttagctacttggctttcatcttgtgcggctgctaaaaaccatttacgtgcagaaatcgcattagtcatagtttcctgtgttgtgaaagtttttgaagcaactaaaaataaggttgtttccggatttacttttttcaacgtctccgctatatgcgttccatcaacattggaaacaaagtgcatggttaaatgatttttatagggacgtaatgcttccgttaccatataagggcctaaatccgagccgccgataccgatattcaccacatcggtaatcgctttaccggtgtaacctttccaatcaccggaaataacacgttgacaaaaagatttcattttcgccaacactgcatttacttccggcataacatctttaccatctacataaaccggtgtatttgcacaattacgaagtgcggtatgtaatacagcacgattttctgtacgattgatcttttcaccattaaacattgcttcagttgcttcattcaaagcacattctttagctaactgacgtaataaagataatgtttgttgattaatattattttttgaataatccactaaaatttgttcggcaaattttaacgaatagtcattaaatcgagtcggttcttgctcaaaaagttgttgaatagtaacttgatttaagtctttttgatgttgctctaaagctttccacgcattagtttgagttggattaatattttgcatcatttttcctctctatggtttaaaaagttaatcaatatattcgatcaatactctaggtgttaatttagtgataagttcatagcttatcataccgctaattgcagaaatttcctcaataggtaattcctttccccataaaataacttcatcacccaccttatcttgactctcaataccaagatctaccgttaacatatccatcgatacacgcccaacaattggtacttttctgccattaatatagaccggtgtaccttgaggcatatcccgtggataaccatctccatacccaatagctacaacgcctattttggtatctctctcactaatccaacttccaccataccccacaggttcaccttttttatgatttctaatagtaattaatgaagaagttaacgtcataaccggaatcaatccataaacctcagcaggcgtattattcggcgagataccatacataataatacctggacgaatccaatctaaataggcttgctgccaaaacaaaatacctgatgaggcaacaatagatcgctcaccttgtttaccctcggtaacttgtaaaaaacgctctaattgaatttccgtataaccacacatcaattcatctgcccgactaaaatgactcaaaaacccgatttcttttacatttgaacattgaacaagttgctgataaaagtcttctacctgttcaagatctacacctaaacgatgcattcctgtgtcaattttcaaccatactttaattttattcggcaacttggctttcttaagctcataaagctgttcttgattatggataactgtttgaatgttattaacagcaataattggcaaatcatcctcggaaaaaaaaccctctaataataaaataggtttagtaataccttcagtgcatagacgtaatgcttccgataatctagccacaccaaaacagtcaaccagatgatgcagagtagaggaaacgaactccaaaccatgtccataagcatttgccttaacaattgcaatgactttactgtttttggctttttgcttaataacttgaatattatgttttaatgcaacagaactaatcctggctgttggaggtatgacattcattgattcgactctaatcttattttgtataatactgcggtatatttgctaaattatcaaaacgtgaatattgcccctgaaaggctaatttcactgttccaataggtccattacgttgcttaccgataataatttccgcaatgcccttattatcttccgttgtttcgttataaacttcatctcgataaataaacataatcaaatccgcatcttgttcaatggatcccgattcacgcaaatccgagtttataggtcgcctatcccctctgttctccaatgtacgatttaactgagaaagtgcaaccacaggaacttttaattctttcgctaatgcttttaaggaacgagaaatttctgcaatttctaaagtgcggttattttcaaatcctggagctcgcattaattgcaaatagtcaaccatgattaaacttaacccgccattttctcgatacactcgtcttgctctggagcgtaattccgttggtgttaatcccgaagaatcatcaatatacaagttaggtttttgcttaaacatcccaaaagttccggaaattttagcaaaatcttgctgtgttaaattacctgtacggattttaacctgatccactcgagaaagtgaggctaacatacgcatcaaaatctgttcagccggcatctccaagctaaaaaccaaaaccggtttttccgataacatcgcagcattctcacataaattcatagcaaatgttgtcttacccatcgaaggacgagctgcaacaataattaaatcggatttctgtaatccggatgttttttgatccaatgcagtaaaaccggttgaaacaccggtcacaccgttatttgttggtgtagccgccagattttcaattttatcaatagtgttaaaaagaagatttattacattttgcggtccttcattagctgatgttcgtttttccgcaatagaaaatatatcacgctccgcattatccaaaatgtcttttattgcttgcccatttggtttatacgcattttttacaatattatttcccactgaaattaactcacgtaaaattgctttttcacgcacaatttcagcataagtcaaaatattggcagcactcggcgtattgttggacaactctgctaaataagcaaaaccaccgacctcttcactttttccttttgtctttaacacctcatcaagaactaataaatcaacaggggtattttgtgcaaataataatgcaatttcttgaaaaataatccgatgctcaaaagtataaaaatcttcggcaatgatctgatccgctacgctatcccaataacgattatctaatagaatcccacctaaaacagcttgctccgcttcaatggaatgaggaggaatgagggtttgctcaaattttttatctttgatccgtgcagattgatttgaaccggtagttgctttagtcattaaaagaaaaattacctaattagaaattgaaaactgtgctatatgatataccaaatctaagcgagaattaagagagagggaaaaattaatcaaaacaatataagtgatgaaaagcaaccgcaccttaaagtgcggttatttttgataaattttacttcttacgtcgttcaattaatgcctcagacaattgttgtaatacgatttctgtatctgaccaaccaatacaagcatcggtaatactttgtccataggtaagtgcttttgcttccactaaatcttgacgaccttcaactaaatggctttcaaccatgacaccaaaaatttgttttgaaccattagcaatttgagtacagacatcagtgcaaacatctaactgttttttaaattgtttactgctgttcgcatgactaaaatccaccataacatgcggaatgcgaccggttttttctatatccgcacaaactgtccgaacatcttccgcactataattaggacctttctcacctccacgcaaaataatatgacaatcctcatttccttttgtagacacaattgctgaatgaccaaattttgttacagatagaaaataatgtggtgcttctgccgtacctattgcatcaagagcaatgcgaactccaccgttagttccattcttaaagcccaccgcacatgacaaaccggatgccaattcacgatgaacttgcgattccgttgttcttgctccaattgccccccaactcataaagtccgcaaggtattgcggtgaaatcatatctaaaaattcaccggcagtaggcatttccatatcgttaatatcagataataatttacgtgcaatacgcaaaccatcatttaaagcataactaccatctaaatgaggatcattcactaatcctttccaacccacagttgtacgtggtttttcaaaatacacacgcattataatttccaacgtatcatgatattttatacgcatttctttaatgcgtttagcatattccaacgcagaagcaggatcatgaatagaacaaggtccaataataacgagtaaacgatcatctttttgatgaataatgttatgtgctgccaagcgggctttttttactgttttaatggctacatcacttgcaggaaatttttctaataatgcaatagggggcaaaacttgctcaacttttgcaattctggtgtcatcatttgcaatacgaatattatttttattcttagccatatactactctctcttactacataaaatttacaatcatagaattaacaatttatatttaatggtattaaacgtaacatttatttttgtactagtaaactaatttctcctagtacgcacttaagacttgtgcaggttgtaatttagccgctcggcttgctggatataaacttgctaataaactcaacatcaaagcgaccactagtaccataagtacatcttgccaatgtaattcgctcggtaaaaaatcaataaaataaattccatctgataataactttttatccagtaaaaattcaataaattgaatcagatcggttaaatttaaactcagtattacccccaatgctattccaactaaacagcctttcatacctgattgcaacccgtaccaaacaaaaatttgtttaataaaacgattattagcccccaatgtacgcataatagcaatatcagcctgtttatcttttactgccataatcaaagttgacacaatattaaaacaggcaacacctatcaccaacaccatcgcaatatacattactgttctaattaactgaatatcgttatacatataaccaaacttgccaatccaatcttgaacttgtaggcgttgcggataatcatataaatattcatacgtcatatttctaaccgcaaaaggatcttgaacttttagctcaaccccagtaatttcatcgggcgcataatccaataatacttgtgcttgcgataagctcatcaacgcataactatgatccaattgcccatctaaacgcaaaatacctgttacttgaatgcgataacggagaggctgagataattgattatcgctattagcaaaagaaattaataacgttacccaatcattttcggatacacctaattctttcgcaatgccatagcctaaaaccaaaccgccatttttctgaaattgttgccagccatcatttaacacaaatttactcaaattactcacttgatcttgtgtaacttgttctattcccctcacttgagctactttcagttttgtgccgttttcaattaatgccgtaaattcaacaaaaggggattgtgctaaaacatttggatcctgctgtaaaagtgcggtaattttttgtcgactttcaatcttgacatttccttgctcttgatacgatataatttcactatgtggaacaacagataaaatacgctgattaagttctcgctcaaaaccattcatcgcacttaatcctacaatcaacactgccacacctaatgcaattccaatagttgaaaataaagcaattaatgataccaacttatttttagaacgactgtattgataacgccagctaataaaaaatggagtattcatgagttactttccctcaagataccgtcttgcatcactaaacggcgatccaacttttccgctaattgcaaatcatgagttactaataaaaatgcaattttttgttcctgattaagtttttggataagttcaaaaatactttctgttgtcttatgatccaaatttcccgtaggttcatcagccaacacgagttttggattattcaccaacgatctagcaattgcaacacgttgacgctctccgccagaaagtgcggacggtttatgcaaaattctcttagccaatcccaccgcacttagtatattctcagctcgatctttcgcctctgttttatttttgtgactaattaacatcggcatcatcacattttcaagtgcggtaaaatccgccattaaatgatgaaattgatacacaaatcctaaatactgattacgcagtttagctaattcgtcctgtgttgccctttgtagtgattgcccatgaataaaaacttcaccgcttgttggctgatctaatccgcctaacatatgtaaaagagtacttttgccggatccggaacttcctacaatagcaattaattctccttcctgcatggaaaaagacacctcttttaagacttgagtttgaagacttccttcctgataatgctttgtaatattttgacagattaataatctattcatcgtttgctccagttctcttattattcataacgtaatgcttgtgctggctcaattttactcgctcggtaagccggataaattgttgatattaaagataatgttaacgagaaaaataaaattaacgcaatttgataaacgttaatttctgtcggtaaaaaaataccctgaggattaatccactgaataatcttcgccaaattcattgctacaacaacccctaagccgccacctaacacagcaccgcttgcccctacaaaaaaaccttgcaaaataaaaatattacgcacttgtccttttctcaatccctgtgtttgtaaaatagcaatttcaccttgtttatccaccaccattaaacttaatgaagtaacaatattagaaaccgccaccacaataattaaactaattagcaagctcatcatattcttttccatgcgaactgcttggaaaaactcccctttttgactacgccaatctacaattttccattgctcagtagggaaaaacttaggcaattcactaatgaaaaaaggatcttgcaaaaataagcgataaccttgaacttgttcaggtttaatccgcattaagcgtccaatatccgctaaattggcaaaaactgcatagcttgcctgttcagaaaaggaagagtaaatatcactgatggtaaataaacgttgtaccggaactcgaccaaagggagtatattggctattttccgtcaccatcactcgaactttatcaccaatctgtacgtttaatttttgtgccaatttccaaccgataattaatttaaactcaccgattgaaagaagttgcgaaaaatgattttctgaaaactcactcaataaaggatcatcagaaaatttttgcaccccaagaatttgcccggcactgacaccttgtgcagtttgaaacacggcagaagttgtattaatcggcacaactttttgcacaaaatcgggcatgtccggttgcgaatcggtcaaatatatagaattatttttaggcattaaaatactgtgcggaatattggaaagaacctgttgtttttgatatttttccaagccgttcatcacagacaaaacaataattaacgccataacacctaaaataataccaacggtagcaagcgtcgtaactaattgcccgaagtgatccgcacttttagcccgccaatagcgtaatgcaataaaaagagaaattggaaaggtcatcttataatctataaaattacaaatctatgaattcacgttgcgactacatcaagaaaataaaaacaataaaattggatttattaaaccagtgttttctttgttactgaaaattaatctaacaaacccaatttagtcatttttactgagtaaataaaatcagcttaactaattatttacctgttttgacaaactcttcaatattttgtgcaactttgttcaccaaagtggtcaccgcactatctgatgcccatgcaatatgtggagtaacaatcaagtttggtaaacgagtagctgcctgaataagcggattctctttctcaggcggctctttaaccagtacatcaatagccgctgcggcaatcactttattttccaatgcttcaaccagtgcctgttcatcaactaaagggcctcgtccggtattaattaagtaagccgtcggtttcattaactttaacgtttctgcattaatcaaattttgtgtttgctccgttaaaggacaatgcaaagtcacaatatccgcttgctttaaaacctgttcaaaaggtaaatatcccgaacgaatttccgttgcaccacaacgttcagcgtaaatcacattcataccaagtgcggtcgctaatcgaccaatttccgaacctaaacaacctttaccgatcacgcctaaagttgatcctttaacatcggtaatcggataatcaaaatagcagaattgtttacagtctgcccattttgcacttagctgatctctgtaccaattcattaaactatgttttaaggcaaaaattaaacctaagacatgctcaggtacggttaccgaagaatagccggttacattttttactgtaatacccaattctttagctgctattaaatcaacattattcgttcccgttgccgtaatagcgattaattttaacttaggtaattgcaacatcacctcacgactgaaaataaccttactggtaataacaatatcagcctcttttgcacgatctatcaactgatcagcatcggtatattcatattcaatccattgatgctcaaaacttgggcgaggaatagtaatatgttttggaattgccgtactgtctaaaaatacaatttgcatcattttctccttagttaattggaataggccgtgtcaatataccaaagtaataaacataaatatagaaaaaatccgtattcactaaaaatacggatttttcattatgctcatttaatttgaagtatctatttcctcaaaagatttaactagatcatcaatagctttcatttgtgcaacaaaaggttcaagttttgataaaggtaatgccgatggtccatcacactttgcttggtttggattaggatgagattctaagaataatccggctaatccaatcgccataccggaacgagccaattcggttacctgatcacgacgaccaccggaagctgccccaaaaggatcacgacattgtaaagaatgagttacgtcaaaaataacagggcaaccttgcgacacttttttcataatattgaaaccgagcatgtccaccactaagttgtcataaccaaaattagtacctcgatcacacaaaatcaccttattatttccacattctgcgattttttccacaatattacctatttgacctgggcttaaaaattgtggttttttcacattaatcaccgcacctgtacgagccatcgcttcaactaaatcagtttgacgagctaaaaaagccggtagttgaataatatcaacgacttccgctacaggtcggcattgataaatttcatgtacatcagtaatcacttttacaccaaaagtctcttttaattcttggaaaatttttaatccttcttccattcccggaccacgataagaatgaatagaagatcgattagctttgtcaaatgaggctttaaatatatagggtacgcctaatttttgcgtaacttctacatatttttcacaaacttgcatcgccatatcacgactttccaacacattcataccaccgaataaaacaaaaggcttattattgccgatttcaatattgcctaactgaataacttgattttgcataatcatttccttactaatgaatagattcaatttctaattgtaaatattccaattgaggtaataataaaagtgcggtcggatcttccggacatttttctaaaaaatattcaaagtcattcaatgccgcttgcatacaccccatttgagttaataccaccccacgatcacgaatttcataaggatcatcaggatttctggacaagagcatatcaatatattgatatgcctcattatttctaaattcacgaattaacgcatgctttgctaattgacaaaaccgattcgttaattcttgcacatctgcaacttctaatatctccaagcttaattcagtaccaaaaccaaatgctccttcatataacttttttagctgagaatatgtcatatattgaccattccaaggatcaataaaggcgacctcttcatcaacatcagcacgcaaaattaattgcgtaggaaaattgaccggataaatgggcaaattcaaactttcagccaagtataaaactattgctcccagtgttaccggcattcctcttcgttgcgttaacacttgatccaaatataaattctccaacgcaaaataccgttcgggatcacaaaaaaatccccattctccatacatcaactgcaataaatgatgaatttttcttttagtttcccaattagaatcaatttttttacgagcttcacgaaccaaaccaccaatcatgcctcgaatacgccgtatttctttactactattgtcatgcgtaataagataaaaagaggtcatttcatcatataatgctttatgataatacttcattttttcctcttaattgagctaatgttattcgctcattaccgccataatcgttaatcgtttcaacttgtttccacagtttctcggcaaaaaaagaccgcactttttgcccttgctgccagccatgctctactaataaaaaaccttgtttttttaaataattaggagcttgctcaataatatattgcaaatcggcatatccttttttttctgccaccaacgccgtcaaaggctcaaaacgtacatcaccctgatttaaatgctgatcttccgcatcaatataagggggattactgacaattaaatcaaattgtccagttacttgctcaaaccaattactttgcaaaaactgtacttcggtcaaatgattacgcactgcattagtttttgctaatttaacagcgtcggcaataacatccagaccaaatatctcaaaatgttgaccgctctttttcagttcatcagccaacgccaaagctatagcaccagtccctgttcctaaatctaaaatacgaatgggggattgagtaaagtcttttgatttcttaagcaattgaatgcaaaccagtgcttgttcaaccaaaatctcagtatctggacgtggaattaaagtatagggagccacctgtaaatttaatgtccaaaattccgtttcacccagcacatacgccattggttcacctttagcacggcgaaccaataattctgtgagttgtttcaattcatcctctgtcaataaggtttctgaaaaagctaaaatcgctgattttgaacgtttggtgacggtttgcaataacaaatttgcatcaactttagcatctaagaaaggatctttagcaacattctcaaataaacgtttttcggcaagttccagccattgttgataattcatttctttagtgaaacttaagttttcttcacaacgatagtcgacataactatatccactaacgaacgtctttccttatttgcaaaagcaacaattgcactaactaaagttaagatacctgttaatgcaaaaagctgttcaataaattcacgcaatacataacgacccaatgttaagggttgatttgttctatagtctatcacttgtaaatttagccatttctttgctaatgtttgcttagcgttatacatgaggaataattgatatccgatatagaggaaaataaaaatgagacctgcaatctggttcaaaacaatagatccaaacaaaatagccacatagaacaacaatacatttatgagggaaactaaccaacgcttaaatcgactagcataaacaatatctgatacgttattagaatttgcttgtaatttatgatcttcttcaacaataaatttacgattttcatcattagaattgtttttttcattgaatttttcaacaatcatcgtatctccttctcataatcttaagaggaattttttcttcgtcagaatagattaattttgttcggacaacattgccaactgatctgcttgatattccgtaataattggttgaattagctcgtcaatcttgccattcatcacttcatcaaggcgatataccgttaaattgatacgatgatccgttacacgaccttgcgggtaattgtaagtacgaattttatctgatcgatcgcctgaacctaataaattacgacgagtatccgcttgggcttgagcttgacgttcctgttcagcttgtgcaatacgagaagctaaaacggaaagtgccttcgccttattcttatgttgtgaacgctcatcttggcattccactacaatacccgtcggaatatgcgtaatacgcaccgcagaatccgttgtattaacatgctgaccacctgctcccgaagagcggtaggtatcaatacgcaaatccgacggattaatctccggcatttcattttccggtaattcaggcataacagctacggtacacgcagacgtatgaattctgccctgagattctgtttttggtacacgttgtacacgatgcccaccggactcaaacttcagttgaccatacacgccttcgccattcactttgacaataatttctttatatccgccttgctcactttcatttgcattcaatacttccacacgccaacgtttactttctgcataacgactgtacatgcgaaataaatcaccggcaaaaataccagcttcatcaccgccagttccagcacgaatttctaaataagcattgtattcatcatttggatctttaggtaataacaggatttgtaattgttgctccgcattttcaatttcagcttttgactcttctatttccaattcagccatttctttcatatcaggatcatcaagcaatagttgtgtttcttcaatattgttattcaaccaattccaacgtgcaaaacattttacaacatcttctaattgagcatattcttttgaataagcacggaatttatcttgatcgttaatgacagacggctccccaagcaacgcttcaagttcttcatgtctctcttttaagctctctaatttactaataatactggctttcattctctaaccttacaaaataataatgtaaatttaaatttcaaaatttaatatcaccgaaccattggtatattttatcgtgtattcgagtaccataaaaatcgacaatatttctatcatatttgaaaacagcggtggaaaataaggtaatcactctttcaaaattcacatcaagcaattcaaatagttcactcggcacaacatcttgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaaaataatctgtccaatctaaatgatcagcaccataaacaggaatacggtcaatcttaaatcgataaaaataaagtttataatagagacgccaaaattttgttattttctttttaatggcaacatagtgcttgattttatactttttatgtaattcaaaatcttcattaaaaacaaataacacttcatctaaatgatatttatttaacatcagaaaaatcaacaacattcttaaactgctgacaataacaattgctttgattttcatattacacttcatgatattcaactattttggctctaaatcttggattattacccaactccgaaaacagaaaattcaattcgaggctgccttagaattacctaaaacagcctctatataataaccataatagcagagctacattacagaaacatttaaagtggagccaccaacaatacgaactcgagctcccggcactaaagttgcatcatacttttgcacaacaacaatttcttgtccattgtcttttctgataacaagttccaacgcattaatctgacttgctttttcttctactttactgccaattaccgctccggcaatagcaccaactgctgcagcgactgcctgtccggtaccaccgcctatactagatcccactattccacctaaagcaccaccaccaacagtcccaatcacaccttggttatcgccttgaattttaaccggacggattgattcgatgataccataactgattgaacgagctgatttagcttgtgtgccactatatacattaccactgtatatatcttcattggcacacccagctaatcccaaactaagtaaaatagctaatgataaagtcatttttttcatagtagttaacctctcttttttgattaatttttagatgttctagaaagccaagaacttgatcttttacgagaaatatttgttactgttataccatcgtcattgtgagagacctctacacaagagcctacaactaaatgagaatcgtaagaatgacttaatacgatctccttaattcctccctcttgctgtttgcaatcatttttacgaatagttaattttaaattatttcctttttgagtagcgaacaaaatttcgcccttatacacattatcattttttgtagatgagcaagctgctaatcctaaaaaacctaataataaagtgaatgctaatgttacttttttcatcgaatctaaccctcaattatctttttgatatgatacgggtgaacttttatgcaagtatgattttctagttgattaacaaaactcactgcaatagacgggttaggtaattgctcgccatccaccttaggttcacttactttaactttcaaattagccaattcctcccataaaaattgttgtcttatacgtgtaacccattcatcaacagtttcattcacttcaaatggaattattacttcaatatgctcccagttttccactggatacactttatctttagggaacggtaattcaataatatcaataaactgatccgaaaaacgtatcggattatcaagttgaattaaataaataactctcccgtttacaatattaccgctcagaattgtaccgcactttaacagcaaagtcagccaatcctccgcagatttacgtttatttactctcaaggcaatatgatcaatttcaacacgatctaaccgtaattgcatggaatgggctaattcaataatttttttttcaaattgttcaaactcatctaatgagatattagattgccgaaacaaagaatgattttggttaaaaatctgcattttttattgctttatcttttctgaataaggaaagagcggtatcataacgcattattttcacaaatcaattattaggtatatcagtgaatattcagtctattttatctaacaaaatcaaacaagcgatgcgtcaagccggtgcagatgaacaatgtgatgctttagtgaaaccatccggtaaacctcagtttggcgattatcaagctaatggaattatggcaacagctaaaaaactgggtttaaatccccgtgattttgctcaaaaagtactcgatctcattgatttaaaaaatattgccgaaaaaatggaaattgcaggccccggatttattaatatcttcttagataaaaattggttggcagaaaatattcaagttaccctacaggataagaaattaggcgttacagtcgaagaaattcaaaccatcgttgtagattattcctcaccgaatgtagcaaaagaaatgcacgttggacatttgcgttcaaccattattggcgatgctgtagttcgtacattggaatttttagggcataacgttattcgagcgaaccatgttggtgactggggtacacaattcggtatgcttattgcctatttggaaaaaatggaaaatgaacatgcttcagcaatggaactggcagatttggaagccttctatcgtgctgctaaagaacattatgataatgatgaaacctttgcagaaaaagcacgtaattacgtggtaaagctacaaaatggtgatgcttattgtcgcacaatgtggaagaaacttgttgatattactatgcaacaaaatcaacgtaattatgatcgcttgaatgtgaccttaacccaaaatgatgtaatgggggaaagtctgtataatccaatgctacctgaaatagttgcggatctaaaagcacaaggtttagccgttgaagatgaaggtgcacaagttgtttacctcgaagaatttaaaaataaagagggtgatccgatgggggttatcgtgcagaaaaaagatggcggtttcctctacacaacaacagatattgcggcggctaaatatcgttatcatacattaaaagcagatcgtgctttggtgttttccgacacacgtcaaagccaacatatgcaacaagcatggttgattactagaaaagccggttatgtgccggacagtttccagctggaacataaaaatttcggtatgatgctaggtaaagacggaaaaccgtttaaaactcgctccggtggaacggttaaactgacagatttattagatgaagcgattgaacgtgcggataaattaatttcagaaaaaagtactgcactttcaagcaaagaaaaagcggctgtgatagaggctgtgggtatcggttcagtcaaatatgcggatctttctaaaaatcggacaaccgactatgtatttgattgggatatcatgttaagttttgaaggaaataccgcaccttatatgcaatatgcttatactcgtattcgttctattttcaacaaaaccgatattagtgaagaacaacttcaccctgcaaagatccagctcacagatgaaaaagagcgtttacttgcaattaaattgctacaatttgaagaaacagtacaaattgtaggcaaagaaggaacaccgcatattctatgtgcctacttgtatgagttagccggtttattctctagtttctacgagcattgccctatcttgaataatgataatgaaaacgtaaaattaagccgtttaaaactcgccttactcaccgaaaaaaccttaaaacaaggtttggatttactcggtataaaaacagtggaaaaaatgtagttcagatatttccattattggttcgtataaaaaaggcaacatccgttgccttttctgtaggttattaatttactcatggtgtcaacaaagttcttaaaactttaccaatatcagccaaacttcttaccgttttcacgccggctttttccaaagcgacaattttttcctctgccgttccttttccgccactaataattgctcctgcatgtcccattcgttttcctttcggagcggttactccggcaatataagccacaacaggtttagttacatgtttatggataaaatcggctgcttcttcctccgcacttccaccaatttcaccaatcatcactatcgcatcagtttcaggatctgcttggaataatttcaaaatatcaataaaactggaaccggggataggatctcctccaatccctacacaagtggattgtccaaacccctcatccgttgtttgttttactgcctcataagttaacgtgccggaacgagaaacaattccgatacgcccttttttatgaatatttcctggcataatccccattttgcattcctctggtgtaataacaccgggacaatttggaccaatcatcacgacatcactttgctgtaatttttttttcacctccaacatatccaacgttggaataccttctgtgatgcaaacaataaacttaatgcccccatcaattgcttctaaaatagcatctttacaaaaaggtgccggaacataaatcatggttgcggtagcaccagttttctccactgcctcacgaacagtattaaaaacaggcaatcctaaatgcaacgaaccactttttcctggggaaacccctccaactaattgagtgccataagctaaggcttgttcacaatgaaacgtgccttgtttaccagtaaaaccttgacaaatcactttggtatttttgttaattaaaattgccattattcactctcctttgctgcattaactgcttgttccgctgcttcagttaagctgtttacagcaattaaattcaagttactttgtgctaaaatttcacgtcctaagtccgcatttgttccttccaaacgcacaacaactggaacactcacaccaatttcattgattgcggaaacaattcctttagcaattaaatcacaacgcacaataccgccaaaaatattcactaatacggctttaaccgcactgtccgttaaaataattttgaatgcttccataacacgttcttttgttgctccaccaccgacatcaaggaaatttgctggtcgtccgccatgtaatttaataatatccatcgttcccatggctaaaccggcaccattgaccatacaaccaatattcccatttaacgcaacgtaatttaaattccacttttcagcctcagcctcacgaggatcttcttgcgttaaatcacgcatagaaaacaagtcaggatgacgatacaacgcattatcatcaaccacaacttttgcgtctaagcaaaataattcatcgttttttaaaataaccaatgggttgatttccagtagggataaatctttttcaacaaataatttggcaagttggcaaaaaatttggctgaattgctgaatttgtttccctgataatcctaatttaaatgccaattctcgcccttgatatggcatcgctccaaccaaaggatcgatagttaccctatgcaataagtgcggtgttttttctgctacttcttctatatccataccgccttcacttgatgccataaagacaatacgttgagagctacggtcaataattgcactcaagtacaattctttttgaatttccgcacagggttcaagataaatttgatgaatcggttgtccctgttcatttgtttgaacggtaactaaacgctgtcctaaaaacttagtaaaaaacgaccgcacttcttgtgctgatttaaccacttttactccaccagctttaccacgtccaccggcatggatttgacattttgcaatccattgagaacctgataatttctcaatcgcacttaacgcctgttcaacattttcacaaacataacctttagttacaggtaaaccataatctgcaaaaagttttttactctgatactcatgtaaattcatatcgtccccttattgatacgtttcaataccgcacttttagattatcggtacttctaaatttccagtagcaagcgagtcggatcttccagcaagtccttcactgtcaccaagaaaccgacgctttcacgtccatcgattaaacgatgatcatagcttagtgccaaatacatcattgggcgaataaccacttcaccattaaccgcaacgggacgatctttaatcgcatgcatacccaaaattgcactttgtggcggatttataataggtgttgacattaaagaaccaaaaacgccaccgttagtaatagtaaaattccctcccgttaaatcttcaacggtcaattttccatcacgacctttttccgccaacaatttaatttctttttcaatatctgccatacttaatttatcgcaattacgtacaaccggcgttaccaaacctcgaggtgtggaaacagcaatactaatatcaaaataattgtggtaaacaatatcatcaccatcaatagatgcgttaatctctggatagcgttttagtgcttcaaccaccgctttgatataaaaagacataaatcctaagcgtgcaccatgttgtttctcaaatttttctgcataacgcttgcgtaaattcataatcggctgcatatccacttcattaaatgtcgtcagcattgcagtagtattttttgcttccagtaaacgctctgcgatacgcttacgtaaacgtgtcattggtacacgtttttcattgcgatgatcaattttcaacccagttgcaatagactgagatgcttgtgccgtttctgtttgttgtactttttgcttaaccactaacgctatatcttcacgagtaattcgaccacctacacctgtacctttaatttcatcagcatttaattcatgctccgctaacaaacgacgaacagccggactcagtacatcgctacttgcatcagtattcaaattagccgaatgacgatctgccggtgttttttccacattctgtacagttgattttgtaacttctccaatacctgccgaagcggatactttacccaacaattgtttactcacgacagttgaaccttccggttgtaaaatagtttcaagcactccatcactaagtgcgggaatttccaacacaattttatcagtttcaatttccaccaaaacttcatcacattttaccgcatcacccacgttcttatgccacgttacaacggttgcatccgccacagattcagggagatccggagtaataatatcgaaattgctcatattttttcctcctattcatatttcgcttaaaattagatatatattcgttaattattgaaaatttttccaatactttaacctagcaaaattacgctaatgcctcagttaccaaagctcgttgttgctcattatgtagagataaatagcccactgccggtgaagctgaagctggacgaccaacataacgcaacttaccatgtgggggtaatgatgtccaaaaattatgctgacagcaataccaagcaccttggtttaacggttcttcctgacaccaaacataatcagttacgtgagagtaaggagctaaaacctctttcatttcttcatgaggatacggataaagttgctcaatacgaataattgccacatctgtctgattatttgctcgacgttgttccaataaatcataataaacttttccggaacacatcacgacacgacgaactttttgaggatcaatagcatcaatttccgcaatcacattttgatattttccattcactaactcctccatagtagataccacaagcggacgacgtaacaatgattttggtgtaataacaattaatggacgacgtactttacgcaacatttgacgacgtaataaatgataaatttgtgccggagtagaaggtacacatacttgcatgttttgctgtgcacagagttgcaaataacgctccaagcgagcagaagaatgttctggaccttgcccttcatatccatgtggcaacaacatcactaaaccacacatacgtccccatttttgctcgccggaactaataaattgatcgatcacaacttgtgcaacattcgcaaaatcaccaaattgtgcctcccaaatagttaatgtccgtggtgccgctgttgcgtaaccatattcataagctaaaacagcttcttctgataatacagaatcccaaacttcaaaacgcccttgttgagcatgtaattgagttaatggaatatacaacgtcgcatctttttgattgtgtaatactgaatggcgatgaaagaaagtaccacgtcccacatcctcaccagataaacgaacattatatccctcatcaagcaaggtcgcataagccattgtttcagccataccccaatcaaataatttatcgccttgtgccattgataaacgatcatcgtaaagttttttcactcgaggatgtaatgaatgcgaacttggataatcacatactttcttagctaatccgacaaaacgctcagaatcaaaggaaccatcatactcagtccattcttgcgttaagtacttagtccaatctttcgtttcaatatccgcttcacgccattccggtacaacacaacctccattatccaaagcatctcgatatttatttgctaattcaattgcatatgcttcatcaataataccttcagtaactagacggttcgtataaactttcggaggtgttggatgcttacggatacgttcatacataagcggttgagtaacagcaggttcatctgcttcattatgcccatgtcgacgatatgacaccaaatcaataaaaatatcacgcttaaattttgctctaaattcaaccgccattcgtgcagcataagcaacagcttccggatcatcaccatttacatggataaccggtgcctcaatcatcttcgctatatcagtacaatattctgttgaacgtgtatcctgtagatttgaagtggtaaaaccaatttgattattaatcaccacacgaattgtcccaccaactgtatagcctctcacttctgacatattcagtgtctcttgaacaatgccctgccctgcaaccgcactatctccatgcaccgtaattggtaacacttgagaatgttcaacgtcctgaatacgattttgtcttgctcgcacagaacctaaaacaacaggattaacaatctctaaatgagaaggattaaatgccaatgctaaatgtacaataccattgtccgtcataaaatcagatgaaaatccctgatgatatttaacatcccccgtcccactgccactatgcttaccggcaaactcatcgaataattctgaaggctttttacccaacacattaaccaatagattcaagcgacctctatgtgccatgcccatcacaatttctttcacaccatttctgctactatgacgaatcatttctttcattaacagtataaaagcatcgctaccttctaaagaaaagcgtttcgctccgggaaatttcgcccctaaataacgctctaatccatctgctgcaattaattcttctaaaaatttcagttgttcttctcgggtgaacagcggtttatctaataacctctcaactttgcgttgcaaccacgtacgagcgtcaagatcgttaacatgcataaattctaaaccaatcgtactgcaataagtctttttcaacgaatcggctaaatcacgtaacgaaatttgctccttgttataaacataaccgccaatatcaaaaacttcatctaaatcattatcagaaaaaccataaaacttataatcaagcgttggtgcctccatacgttgccacatttttaacggatccaaatccgcatgtagatgccctcggttacgatgcccatttatccatttaagcacattaaccaatctcgcactaacattaggatctatcacccccaccccattttgagaagtatcacgtgctaaacgtttaaaataatcacggacttttgaatgaggctgctcaagtgcgttctgttttggaagagaattgaaaacttgttgccaactttcgtcaacagcttgagggttatcaagataatcttcataaagatcctcgacataagactggttcgcaccacctaaagcactggatgccaaccattcactgatagggctattttttttcattatgaccacctaacttgattattgatagcaatttacagtgtaattttttccattatacatagatttagccataaacaatctatttatttgataagctatatcaatttcagctggaaattaaaaatcaaattacctatctaagcaataaaaaagttaaaaagttgttaataattttttatttttttgatctacatctcatttttaaacatccaacaccttatttgtaaaaataatgtaaaatttatgcagacagtaacaaaattaaacgttatattgaaaacatacacaaatattcaacatcttactttctttataaacttttaaactctcaagggggaatgtcttatgtctaaattaacagcaaaacttacacttagtgacggacgtgaatttgatttaaatgttcaacaaggaacgcttggatacgatgctgttgacgttcaaccgttagttaaaaataaattatttacttttgaccccggatttatgtcaactgcctcttgcgtttccgaaatcacctatatagatggtgataacggcgtactgttacatcgtggttatcctattgcggatcttgctaaaaatgcggattatttagaagttgctcatctactgttatttggagaacgcccgaataaagaagaatatgccaactttataaagttggtcaaaaatcatactttagtacatgagcaaatttctcgcttcttccatggattccgtagagactctcaccctatggcgattatgtgcggggtaagcggtgccttagcagctttctatcatgattccttggatattaatgatattgaacaccgagaattaacagcaattcgtttattagcgaaaatgccaacgcttgcggcgatgtgttataaatattctattggacaaccttttatgttcccattaaacaaactttcttatgcaggcaattttttatatatgatgttcgcaacgccttgtgaaccttatgaagttaaccctgtattagaaaaagcgatggatagaattttcattttgcatgcagatcatgaacaaaatgcctcaacatctacagtgcgtaccgctgcttcgtccggagcaaacccttttgcttgtatcgctgcaggaattgcctctctttggggaccggctcatgggggagcaaatgaagcttgtattaacatgttagaagaaatcggttctgttgatcgtattcctgaatacattgcacgagcaaaagataaaaacgatcctttcagattaatgggattcggacatcgagtttataaaaattacgatcctcgagctaaagtgatgcgtcaaacttgccatgaagtattaaaagaattaaacattcagacaccgctctttgacgttgctatggaattagaacgtattgcgttaaatgatccttactttatcgatcataaactgtatccaaatgtcgatttttattcaggaattatcttgaaagcaataggtattccgacatcaatgtttactgttattttcgctttagctagaacagtaggttggattgctcattggaaagaaatgtttaaacctggcaatatgaagattgtacgccctcgtcaattatacaaaggacatacagaacgtaaatttgatgccattgaaaaataatttctgtcagagttaaagtgaagctcgtctctttttgaatggcgagcttgattttttgtaccttattctatttttatcaaaatttacaataaatcgtggtaaaattagactaattaatcataatcgggaatttttctatggcatacactaccttttcacaaactaaaaataatcaattattagaacctatgttttttggtcaaaacgtcaatgttgcccgttatgaccaacaaaaatatgaaacctttgagaaattaattgaaaagcaactctctttcttctggcgaccggaagaagtcgatgtatcacaagaccgcattgattatcaagcactacctgaacatgagaaacacatctttattagtaatctaaaatatcagacattattagattctatccaaggtcgtagccccaatgttgccttactgccattagtttccattccggaattggaaacatggatcgaaacttggacattctcagaaacgattcattcccgttcttatacacatattattcgtaatatcgtaaatgatccgtcaatcgtttttgacgatattgtcacaaacgaagaaattatcaaacgtgcaagagatatttcttcttactatgatgatctaatccgtgacagtcaactttacggattatatggcgagggtacttatacagtggatggtaaagcctgtaaagtcactttacgcaacttaaaacgccaactttatctctgtttaatgagtgtaaatgcgttagaagcaatccgcttttatgtttcctttgcttgctctttcgcttttgctgaacgcaaattaatggaaggtaatgcaaaaatcattaaatttattgcccgtgatgaagcactgcatttgacaggcactcagcatatcctcaacatcatggcggcgggacaagatgatcctgaaatggctgaaatcgctgaagaatgtaaacaagaggcttatgagttattcgttgcagcggcggaacaagaaaaggaatgggctgattatctctttaaagatggctcaatgatcggattaaataaagatattcttgtgcaatatgtggaatatatcacaaacattcgtatgcaagctgtgggcttgccattgcccttccaagcacgttcaaacccaattccttggataaacgcttggttagtatcggataatgttcaagttgcaccacaagaagttgaagtcagttcttatcttgtcggacaaattgatgccaaagtagatacaaatgacttcggtgatttcgatctataaaacacctataaaatcaaccgcactttgacctaggttaaaagtgcggttgatttttactaaaaataatgaagatttatcaagtttatatcagcaattaccggcaaacgcttacccatgccaacgaaatgcctttattggaaaaattagaaaaaaacggcattatacatgaatatcaatgtcgctcaggttattgtggttcatgtcgggtaaaactacaaaaaggcaaagtgtcttataaagaacagccccttgcctttcttaatccaaatgaaatattactttgttgttgccaattggaagatgatatagaaatcgaactctaatctatacacacgcaaaaatgcgacttccaattcacttatctcttaaaaaatatttactggttagcattttccttcgttgttacaaacaatagccaatatcctactacagccgatacactagaaccaaacaagatacctaatcgtgcataagcggttaagtgtccatctcccccaccaaaagcaagactggctaaaaacatcgacatggtaaaccctataccacaaagtaccgaaactgcaaatatctgtttaaaattaataccttcaggtagttttgctatatgcagtttcactgataagtagctaaataaaaacacaccaatcggcttacctaacaataaccccaacgtaacacccagtgttaatggtgaagttaatgcttccatacccaaaccggataaagaaataccggcattacaaaaagcaaagagcggtaaaattaaaaatgagctccaaggtgcaatagcatgttccatttcaaccaaaggttcgctgttatttttacctttcagcggtacacaaaaacctataatgacaccggctaatgtcgcatgtacacctgatttcaatacagatacccaaaggataatcccaacgacaacataagcgattaaatttgatactttgaaacgatttaacaaaattaatccaacaatagaaatacttgctaaaatcaacgcttttgtacttaaatcatgtgagaaaaataaagcaatcacaataattgcacctaaatcatcaataatagccaatgctaataaaaatacttttaaagcaagaggtactcgagtacctagcaacactaatacaccaatagcaaaagcaatatcggtcgccattggaatggcccaaccgccgtgataatcaggaacaccttgatttacaagccaatacactaaagctggtacaatcattccgccacaagccgcaattgccggaaaaatagccttctgatagctggaaatcgcaccaatcaacatctcacgtttcacttccaagccgacgagaacgaagaaaatcgccataaatccgtcatttacccacattaataacggtttattaagttcaacgatagatccgaattgaataatcaccggagcattcagaaaactaaagtaatgatctcttaacggagaattggcaaatatcaccgcccctacagaaaaaaacaataacaggattcctccggcggcctccatttgtaaaaattggcgaatacattcccgaattttttcagtcattattttcattattacttcctttgcataactaaaaacgcatataacaagtttttatcacgaacttttattgagggtcaaggcaaatcaaacaattttttctattgataaaaaaaacacaacaaagttcacaataatattcaacaaatttaacaaaactttatacaaaaacaaatttactcaacacatttaaagctgttgatacactctcaacgcatacgcatcggacattcccgcaatataatcgcaaataattcgcttacgatctgtttctgttgctttttgccaacgcattgctgtattacgaggcagtaaacgcaacggatcactgtcaaaaatttgaaacatttcagtaagcattctttgccctttatattcgacacgttgtgtatcaacatgcttaatcacatattcccacacaaatcgtttaaaaatatttagaacttcaataacttcatcaggtaattcggcgttataacgtaataaaggctcggaaaaaccattatttattttccaacgtatatgcgtaataaaataattcaccaatgcaccgatggcatttttacgctcatagtgtaattccgaaaaaagtttttgactgagcgaggatatagtctgaacaatccattcagaacgacattctgctaatttttccaccgcactttgccactgctgaagcgttaccacaccaacaacaatcgcatcttctaaatcatgtaccgcataagcaatatcatctgcaagctccataatactgcaatccaaagatttataacgggttttcaaaacctcatcaggacgagtacgctcttttttatattgcccgaataaagtgcggtcattttccgataagggttcaagtaaccattcaaacattttcaaatcatcacgaaaaatcccttttcccggtttccacgctgaaatcttcacatatttagaatcaacattatcgacaattaccccttgatgatattgtggggaagaacgatctaaaatcgtaggatatttaacaacgcccaataacgttcgacgagttaaattcattcctgcattaggcgtataaggctcaagcttagttaataaacgaaacgtttgtgcatttccctcaaatcccccatgatgacgcatcatataattcaaggcgacttctccgccatgtccaaagggcggatgaccgatatcatgagcaaaacaaaggctttcaatgaggtcattagatggcagtattaatttaagttgtttttgcaaatctgctcgatcttccttgagctgttgagctaaataaataaaactatcaataagtttcatttgtgcaacgatactgctaccaatttgagcgacctcaagcgaatgggttaaacgagtgcggtaaaaatcattttcgcctatagcgtgaatttgtgtttttgcttgtaaacaacggaaagccgcactatgcaatattctcccacgatcacgacgaaaaggcggacgatgatctttctctctcggcggatcggcaagaaagcgttcttgccaagatgaattaatttgcaacttcatatttattcnnnnnnnnnnnnnnnnnnnnnnnnnnnnnnnnnnnnnnnnnnnnnnnnnntcaacaaaaataataaaatttataaattgatttacttattttattcgttttgttacgttttttcggtagaataagcgaaattaccttgaataaaatgatcaatatgtggaaaaaaatcttttttattttatttttttgtgccatttctagtgtttcagccaaaaatccccgcattcttccttgttatgtagtgaaaattagtgatggcgatacatttacctgctcacttcgcaataacaaaaaggtaaaagtgcgtttacaagaaattgacgcaccggaaaaaggacagccgtttggtaaaaaagcccaacactatcttacaaagttaatttataaaaaaaacgtaaaattgcatgtgtcaagctatgaccgttatcaacgcatgctcgcaacggtttataactcacaaggaaaaaatattaatttagcgatggtaaatgcaggttttgcttgggcatatcaacaatatttaaaagatccgcagtatctacaagcacaaaaatacgcacaacgtaaacgtcttggcttatggcaagatcctcatcctgtatatccacatcaatggcgtaaacaaaaaaagcaaaagataaaaaaatatgatttttgatccaacattatttcgccagcaatttcctttttttcaccaaaaaaatggtatcacttatctagacagtgcggcgaccaccttaaaaccgcaagttctcctggacgcaacgcagcatttttatgcttctgccggctccgtacatcgaagccaatatgatgcaaaacagaccgcactttttgaacaagcgagaaagcaggtcaaaaaactgatcaacgctgaaagtgaagaaaccgttatttggacatccggcaccacacaaagcatcaacattgtcgcctacggcttaatggcacaactttccccaaacgatgaaattatcattagcgaagcggaacatcatgcaaattttgttacttggcaacaaattgctaaaaagtgcggtgcaacattaattattttaccgttgcaagataatttactcattgatcaacaaattctacaaaaatccttaaacaaaaaaacgaaattagtcgccttaaatgtgatctccaatgtaacaggaacacaacaaccgctgacacagcttatccccatcatacgagaaaaaagcagtgccttgattttattagattgtgcacaagccattaaccatcaaaccattgatcttcaaaggcttgatgcagattttatcgttttttccgcacataaaatttatggaccgacagggttgggtgtattaagcggaaaacgttctgctttagaacgattacaacccagttttttcggcggaaaaatggttgaacaggtttcaaaacaagaaactgtttttgcctctttaccttatcgcctagaaagcggcacacccaatattgctggcgtaattggtttcggtgcggtattaaattggctggaacagtggaatatcacacaaggggaacaatttgccgtgcaactggcggaaaaaacaaaagagcggttaaaaaattatcctcattgtcgcctatttaattcgccacacccaagcacatttgtttgctttacattcaccacaatcgccacatcggatattgcgaccctacttgcagaacaacatattgccttgcgtagtggcgaacattgtgcaaaaccctatttacagcgtctaggacaaaaaagcaccttacgcctctctttcgccccttacaataaccaagaagatattgaactgttttttagtgcattggataaaagtttggagttattggcatgattgaacaaatcaaacaagcgaaaaattgggaagaacgttatcgcttaatcattttggcaggaaaaaatctccgccaaccgacagaacagcaattggctgaaatggaaatcattcaaggttgcgaagtcaaagtatggtttaaatgcttacttaaaacagaccgcacttttgaatgccacgcttatagcgaagcaagaattatgaatggcttattatggatgttattgcaagaaatgaacggcaaacaggcgactcaattggcagaatttgatttaatccaatatttcgatgaactcggcattgcccaacgtttaaccgatacaagacttaacggcttaaaacaaattgagcaaaagataaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatattactttttatcttttagcaaagatgaaattatgaggagaaaatttatgattactgaagaagagaaattaagtagaaaaaaagctgttcaatctgcgattgataataatcgtttagaggggttagagcctagtaaagtttttattgatattgctcaaaattgggtcaatggaaatttgactaatgatgaatttggaagaaaagtttatgaaatacacgggcttcgattcccacattgatgaaaataaagtcttaaaaaatcattttgggattaaagatcaaaataagctagatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcacctttgctacagtaggggcgaatcacattcgccccatgacatccacccgaacggagaataaaatacattaaagggcggatgtaatctgmyyctccccttgtttctttaaattgtcatcaatgcggatagttaagtttgaagttgtcataatttaggctcacattgcagataaaaagcaaattacattacatttacatttcattataatttaaatataattagaaccaactttaaatagcgtttaaatgtcatttactttggaggtttattatggattatacaaattttaatatgcgacttgataacgacttgcgtagacgagcttatcctattttggagcagtatggattgacaccaagtcaagcggtaagaatgttttttaatcagattgcacaaaccggtaaaatacccttgtcgtttgattgggcggaaaatcaaacgttaaccccaaaagcagcagcacgattacgccaaactgagcaggaattcgccaatggcgaatttgaacgctttaatagcctagatgaactcaatcaagcgataaaggagatttcgcatggctaaacgcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtggagttacattaccttgatagccatagcgaaatttttggctagcctaccgctctttgttacaaaaatgtcaaaaaaaaccgctccgaagagcggttaaatttttgaggttttattatatattatatattagaagtaaacacgtaagcctgctgcgtaaaaactttctcttatgtttttatcttttgtaggtgctttaacacggctattagcaaattctgcataggctaatagatttttgttaaaggcatagtcagccccgacgataaatacgttttgtactcctttcttatgttcaccaagttttaaatcacctacttttacatcaccgagcgagaaaggaagagaaaatttaccctctatattatcaacagcttgtcttacactattacgttgccattgtgcataaacatttaagacatccggtaacactgcatattttgcaccaacttcaacaaagcgagcggaaccattaaactcatgttgttttttagattgatatactgtttgaccgtattcaatacccaaagatgccggtccgaattctacttgcgttgctaaacgccaagcttgttgttgattatcggttttggagtaaattggaccaggaatggtattttcgttatgaaccgtataaccggcattagcatttacagtaaaatcaccgaaattgccggtatagaatgcagagagaccgtaagtattttttagcctaatatgttttttttctgaatcctttccttgaatatcttttttatgtgcttcaccgaaaccataatcaagaccaaaacctaaagtttgcccttccgctaattggatatctgctgtacggaaagacaccactttatcaccggaagtaaccaagttgttgttaccgccaaagatataggtatgatcatttaattgaacatcatccgcagtggtattttgtttaccgaaagttactttaccgatatcgttatgttttaagcctaaccataatttagaaagtttgatgtcgttaaaagatgtatcttcttttgaagcgtcacctaacccgaaacgaaccgcaccgattgcttttaagccgttttgtacttcatgctccgctttaaattccacacgagatccgttattacgtaaatcggtacgttgagcatcaccgaatttacctaacattacatcaacacgaccgccaacttctactttggtaccgttttgattataaacagttgttgcgtttgctgatgccgcaactgccgctaccgctaatgctactaatgtctttttcataataaaattcctttcaaatttaaattattttactactgaattgaacctttccatatatgaaaagtccaagccaacttttaaaaaaaagcgagcctatattggcaaagaaaccgtttacagtcaactaaatttaataaaaaaatgctaaatttagtgatctaaatcacactttttgaataaattttgaacttttttgcggtacttttatttattttaatgattcgcttaatatcgtttattttccagcaaatacgctacttttgcgttcttctttctctatannnnnnnnnnnnnnnnnnnnnnnnnnnnnnnnnnnnnnnnnnnnnnnnnnatttgattccggcgttagtaatcctaatacttttgaatatgttggattgttttttatctctctattttatataatcggaacccaaaatttaattaaagggggagatatgtacgccattgcttttgatcttgatacttctatgttaaaagagctatattccacagagagttggcaaaatgcttatggtgatgttaaaaagacgcttgaatctttaggttttgatcatcaacaaggtagcgtatattttggtaacgaggatatgactgcggttaaatgtgttttagctacacaaacactatctaagacttactcttggtttaagccgtcagtttcagatattagaatgcttagaattgaagagcttaatgatttatcccctgcgttataagcattattcttttactttataacctctaatacttgttagaggtttttttgtagcttgtgaaatttacctctctcatcgcttaaatattcacttttttcgagcaaataccatgcctttgctttattctttttcttgaactatacggctgttaaccgtataatttaggactattttaacaattaaagagggcgtatagaaatgagaacacaagtaacaaaagcaagattggaagctaaagtaaaccttgatatatacgaattattaaaacaagccgccgcaattacagggcgaaccttaaccgactttgtggtaagtgtagcttatgaagaagccaaaaaaactatttcagaacatcaaattttacgtttgacattaagcgatcaggctttactcattgacaatctcagtaaaccgtttgagcctactcagtcaatgaaaaatgcacttgatgtgtatgaagaatatctttccgttgcggggaaaaataatgataaatgaaaatttaccttatttaagcgtattgcctttagaagatttgacaattgataggaattcattttcctgctcggttgagcctttagaaacctatttttataagtatgcttctcaagatgtaaaaaaaggaattacaaagtgtttcgtgcttataaataaacaacaattcggaattatcggctattacactttatcggcactatcaatccctattaccgatatacctcaagaacgaataagtaaaggtattccatattctaacattcctgcggttttagtaggacgattggctattgatacgaatttccaaaatcaggggtatggcaaatttcttattgcagacgctatttataagataaaaaatgctacggtaggggctgcaattttagtcgttgaagcaaaaaatgatcatgctgtctcattttataagcgacttggttttattgagtttaaaaatttgaaaaaaacacacagaaaattattttatccgctaacttgaaattttcttgaacggttgcttttttagtggtgttcagttccgacaatcggtttgattttttcccatttccgacaagatgggcaattccatgatagtttgtgtgtttggtaaccgcaatgactgcaacgataatcaaagcctcgtgcaattctatctcccacgattttgtgcaataaaatcaaactttcttttgctttgccgttttcagcagcatcaatttggtattgaataaaacgatgtaaaataaatgtacttgggttttgttccagttgttggtgtaatttagtttgtgccgcaacaatgccgtctttttctgcgataagatccgataaagctaaatcaaccgcactattattgccggtttggcttgcccgaataagaaaaagttcaaagttgtctaaccgatttaattcttggtagcaatattttaatgccggtaaaatttcgctcatgtaatccgcattttgtgttagcacattttctagatgttgcaccgcacgttgatattctaaattcacaatataacgttcagcaatgaggatagaggctctaacactcgtttttgaaacattcaatgcttgttgcaaaatatggattgcttgagcttgttgttgctcatcacttcctaaagtcagggaatattcgcagtagtaatgtgctaatgcaatgttatcttccgtaggcgaaattttggcaagtttctcggcaacattgatcgcttttttccattcttttgttttttgataaatgacggctagttgttgtaaagcgttttcagcgtagttcggttcgtcaatcaataaaatataaagattttcagctcgatcataaaagcctatcgtcaaaaaatcttttgctaattgttgtttagcaagaagtttttgttcgaaggtataatttggactgctatccaatgcttgatgaatacgcaaagctctatcaacttcacctcgagaacgatataaatttcctaaggttaattcagcctcaaattgtgaacctgtttcaatgttattttcttgttcctgcttttgtagaatatcaaggaagagatcagccgctttttcgtgttgattagataataataaattaatacctgttacataatcacgagaaaatttattgctaatcgtatcttgatcttttcttgcactacgatgccccatataccagccgtaagctgctgcaatcggtaaaagcaggaaaagtaattcgagcattatacaaccttactctcgatttttgtttaattcatcaattaacgctaattgatgctttacttggcgagataaaaaaagatttctaaattttaatttgatatagaagaaagcggtaattaaccaacctaaaagcagacctagcccaaacaagatagccactaaagttgataaacgtatttcattttgtgcaactacataattaaaggtaataatttgatcattgttagcaccaatagttacagcaactaaaacaaccgtaatcaataaaacaaaacctataatatatttgatcatctgtatctcctataactttctatttatggttaaatcaattagcatcactaaaagctcggccattatgccaaaaaaataaaaaaaacgacactttacgcgtcgtttttttatattttatattacgagtaaatattaacacgctctttcagttctttaccggctttaaaatgaggtacatatttagcacttaaatctaccttttctccggtttttggattacgtcctattctagattgacgaaaatgcaatgaaaaactaccaaatcctcgaatttcaattctttcaccgttttctaatgcttgtgataattgttctagaatgtcttttactgcattttctatatctttcaaaggaacgttaagattggttgatgctaaattttcgataagttctgactttgtcataatatactcctagtgccggttggcataaatcctataattcatgccaaccaaaaagtgaatgaattattcaccttttgccgctttaaatgcttcagccattgcatttggaataacaatttcttctttattcacatttgcaactgccgccgcttcttctgcttggtcttttgctttaacagatagatgaacgatacgagatttacggtcaacaccggtatatttcgcttcaacaacatcaccaacaacaacttcattgctcaaatcagctgtacgaatataaccttcaacgccgcttactaattcaactttagcaccttttgcgtcaacttcaaccactttagcactgaccacagcaccttttttgtttaccgcaatgaaattattaaacggatcttcttccagctgtttgatacctaaagaaatacgctcttttgcagaatcaacttgtaatacaactgcttctacttcgtcaccttttttatagttacgaacagcttcttcacccggaatattccaagaaatatcagataaatgtactaaaccatcaattccgccttcaagaccgatgaaaataccgaaatccgtaatagacttaatcttaccggaaactttatcacctttgttgtgagtttcagcaaactgtaaccatgggttaggtttgcattgttttaaacctaaggaaatacgacgacgttcttcatcgatttccaataccattacttcaacaacatcacctaaatgaacaactttagatgggtgaatatttttatttgtccaatccatttctgacacatgaaccaaaccttcaacaccttctaaaatttcaacaaagcaaccataatcagttaagttagttactttacctgttaatttgctgttcaccggatgattttctgcgatggctacccaaggatcttgacccaattgttttaagcctaaagatacacgtgttttatctttgtcaaatttgaggactttaactgtaatttcatcgccgacacttacaatttcacccggatgtttaacacgtttccacgccatatcggtgatatgcaataaaccgtcaacaccacctaaatcaacaaatgcaccgtaatcggttaagtttttaacagtacctttaacttctgaaccttcagctaagttagctaaaatttcttcacgttcttgactattttctgattcgatgactgcacgacgagataccacaacattgttgcgtttttgatctaatttaatgactttaaattcttgttctttacctaataggtgatccgcttcacgagttgggcgagtatctaccaatgagcccggtaagaacgcacgaacaccgtttaactcaactgtgaaaccgcctttcactttaccgttgattaaaccgataacagttgcttgttcttcgtatgctttttctaaatcaatccaagattcttgacgtaccgctttttcacgtgaaagtttagtttcaccgaaaccgtcttcaacagcgtccaaagcaacgtttacaacgtcacccactttaacgtccaattcaccttgagcattttggaattcttccgccggaatacgagcttctgatttcaaacctgcatctacgtacacgaagcctttttcgatagcaacaacagtagcgttaacgattgaacctacacgagtttcaaggtcttttaatgattcttcaaatagttgagcaaaagattctgacataattaatcttctaaatttaagttaataacgaccactttaatttccataaaaagtggggctgataataaatgtttattcaatccttgaataaacgagttcagattccaacggagagttcatcacacgactgatatgctctaatgcttgtttgatcacatcatcaattgttaattccgtgctatcaagtaataaagcatcttctgcgggtttcaagggagcgactggacgatttctatcacgaaaatcacgctcttttatctcggtcaaaatctgtgcaaagttaccattaattcctttattttgcaactgtttatgacgtctttttgctctttcttccgcactagcatctaaaaaaatttttacttgagcatgcggaaataccactgtccccatatcacgcccatctgcaataagcccttccccgtttgcaaaatctcgttgtaattgcaataacgctgttctaacttgtggaaacaccgcaatttgagacgcagcttcagccacttcttgtgtacgaatttttgtactgacattctcattttgcaaaatgatattcacttcgccatgttgtggaataaattgaatgtcgagactacgggctaattcagtcagtgccgtttcatcatcaagtgccacacctttttttaacgctgccaatgctgtcacacgataaattgctccgctgtctaataatcggaaccccagtttctcagctaaggcataacatagtgtacctttgcccgctccacttggtccgtcaacagtaataatcagatttttattcataaattgaaccttgatacaaaaatgcgtcatatatcatgacgcactttattttttattcggctaatttcttctcaacagccttcaatcgcttgtttattttatcaatatctaaagttaatgcagcagttttacgccataccttatttggctgtaacggaattccggaagaatatattcccggttctgtgattggtcgcatcaccatacccattccagtaattgttactttatcacaaatttccatatgcccattaataacacttgctccgccaattaagcaatagcgaccaactttcaaactacccgccataataacaccgccggcaacagcagtacctgttccaatatgaacattatgtgcaatttggcaaagattatctatgattacattatcctcaatcacagtcgcatcaagtgcacctcggtcaatacaagtgcaggcaccgatttcaacatgattgcctataatgacagttcccgtttgtggaattttaatccagcgaccacgatcatttgcataaccaaatccatcactaccaattaccgcacctgattgaatgagacaatctgagccgattttaacgtcatgataaatattgacatttgcccaaagctgggtattttcaccaatctgcacatgtttaccgataaagcaacctgcaccaatcaccacattgtcaccaagtataactccgtcttcaatcaccgcattagccccaatggaaacatgttgacctaacgttgccgtgtcggaaacgaccgcactttggtgaatgccttgagcggctttgggtgtgctgtccatgtattgtgccaaaatagcgtatgcaacataaggatcttttactacgagcaaattactttgtgcagaacagaattcgatatcactttcggttacaattaatgcaccggcttgtgattgaagcaaatgttctcgaaatttaggattggaaataaaggtcagttggttgttatccgctttatctaaaggtgctatgtccgttacaataacatcggcgttaccacgaatggtagcgccgatttgttgagccaattccagtaaagaatatccttgcattacttagcctttgctggagctggagccggaatagcttttagaacttcctcggtaatatttttaccgtcagcaacataaattgccgttttttcatccaatacaattgtaaagtttttggctttagctacattcgttgtagctgtttgaacctcttttaataaacgttgagtaatttcggcatcacgtttttgtgcttcagcttgaaacgctgcaacatttttttggtgctccgctaccagcttgttaaactcgtcattacgttttgttaccaatttagcaatttcatcttgacgttttttgatatcagcttgacgtagtttcggtgcatctttttccaatgctttactttttgtttcaatttctttttcaaaattgtcacgtttttcaactaatgctttatctgctgcttccagtttttctgctggtgctttaaattcctcatttaatttttgaaactcaagcaagcgagcagggtgatttaaaaacaagtactctgtattaacaacagcgatattatcacttgccattgcaattgatgagcctaatgcgatagaaagagcggtcagttttactgcatttttcattgtttgaatatccttaataaattaattttaattgagttccgtacaatttaattatacgggtttcatatcagactattaattatagccgaaagttccctaaaaagaaccaccaatactaaattggaattgttcaatttggtcaccttgatattttttcagtggtttagcataagagaatactaaaggtccaatcggagaataccattggaacgcaatccctgctgaaactcttatacgagctgggttcccgtagtcaggtatatttttatctccagcaaatggtttaccatctgatttccatttagtattccatacagaaccagcatcggcaaagatagaggttctcactgatcgttggtttttctctgctacaaacggcgtcggaacaataagttcaatacttgccaatgtcatggcatttccgccaacaatatctttgctatggcatttatattggttttggcttgtactttgcataactccagccgcactgttttgcattgcactacaatttctattcccctgataaatcgcttttggtcctattgcaccatattcaaaaccacgtacagttcctatacctccagcagagtaagtttgataaaacggtaaacgtttaccgccaaaaccgtttgcatatgatcctgacaatctacctgtcagtacccaataatgatcacgatccaatggataaaaaccctgcacttcagcactcactttatagtatctgttatctgaacctgggattgttactttaccgccaacattcgctcttactccggaggtaggcaaatagccacggtttaagctgttatagttccagccgaatgaaaattcaaagtcatgcgatttaaaattccatctattagaatcaggataccccattgatttgcgatataaatcacgattatattctttcgtcacattttttaattggctataaatatgccctaaacttaaataataggagttattttcattgaccggaaaacttaaatttccacttagaccgtaagttgtacgtccataggcggctgcagtatcactttttgagttatcgtgtttttcaaaaaatgcgtttccacctaaacttacgccatctttagtaaagtacggttcgttataacctaaattaagacttgtgccataattgttgcgtgaaccggctaaactaatcgaggaacccatgcccaagaaattatcctgtttaatacttgcctgataacttataccactttcggtaccataaccaataccgaagttcaaactccctgtattgcgttctttgactcgataaatgacatcaacttggtcgttaatttgttgattggtttgagtttccgtttccactgactcaaaaaatccggtacgctctagacgaattttccctaactcaactaattgagatgataaccaagccccctcttgttgacgcatttcttgacgtaatgtgctatcggcagtaatcgtattcccctcaaagcggatttgacgaacagaataacgatgtcccgcatcaacaacaaacgttaaatcaatcgttttgttctcttcattaaagactgaactaacatctacttttgccgttgcatagccttgctcgcttaattttgcttttatcaattgttcaacactgctaacttcactacgacggaaagtttctccgacataaatgtttttaagtaacggagctaactcttctgacataccgcctacatcaccaacgattcggacactatttacagaatacttatcaccttcgttaacttgaattctaactctaacctcagttttttcgtcatttagctgaacatcggtaccaacgatttgaaattttgcataaccatgttctaaataaaaatcacgaataagatccaaatcttggttaaattgattggtatcaaatttattcccaaataacttccaccaagcatccggctgtaattccatccgctcttgtaattggctactgctaaatgcttcattgccctcaaaacgcacttctttcagttttgccacatcactttcttttattttaagttttacttctgcccgatcatttgataatggattaacaattgcctctacagtcgtattataacgaccgacagactgataatgatcaactaaacttccacgaaacgcttccaatttttctcgatttaaaatatcaccgctagcaaatccgttcgctttcaagttttctcgtattgcttcactaggaatagattcatttccctccactttcacttccgcaatcactaagcgtggtactacagaaatgactaaggtatttccttcacgaacagcttgcacattatcatagccacgcaaaaataatagtcttacgacatttgaaatatcactctccgttgctttttgtccaattcgaaccggcaatccagataacaccgcactttccttacctgcttgaataccgtttatacgaatatcttgcacgacaaacggtgcggcaaccagaccagtcgagccaaataataggcttgcaattaacagttttttcattgttagttctatcctctaataaagaaatatctaagagtctgtttatcgattaaacaaaatcctgacgattataaacgtaaaaaatcattaaacaatacaaatattgttaatatcaataataatcccgcaccaattttatacgcaatattttgcatttgctcagataagggcttacctttgagtgcttctatggctaaaaaaagtaaatgccctccatccaataccggcaatgggaataagttcataatacctaaattcacactaatcaacgccataaagctgagatagtacacaaaacctatttccgaagatgccccagcacctttagcaatggaaatcggaccacttaaatttttagctgaaaactctcctgtaagcagcttaccgataatttgaatagttaatttgctcaattgataagttttctcaataccttttataaacgcctcaaaaaaaccatattttaattctgtacgatattcatcacttataggataaatagtcggtgcaacaccaacgaaccatttccctttttcatttaagtgcggtgtaatcaccttatccagccattctccatgacgtaatacttgaacattgaaactatcccctttatcaacaaaactgataaaatcacgccatttcattggttcattttgataatagatttgatcaccaattaataaccctgcccgttgtgctggagaattttcaacgaccttagacagtatcatctcaattttagttcttaccggaacaatccctaatgcaccaaaggccgtttctttttcaggatcaaagttccattcagataaatccaatacttttctttgctcgatatttgttgttgaggacttcaaaagtgttagcgtaacgctttcctcccccatttttgtagcaagaaccatattgatactttcccaatccggtgtcgatgtcccgtcaattgccataatttgtgagtaaggttcaagccctgccttctctgccaaagattgaggaaccacattttcaataacaggtttaatactggggataccgatagaataaaccgtcaaataggctaaaatcgcaaacagaaaatttgctataggacctgccgcaataacaaaagcacgttgcaaaatagatttattgttaaaggcttgtgattttaagttgtcaggaacttgttcattacgttcatccaacatttttacatatccgcctaaagggattgcggacacggcaaattccgtgccttgtttatccactttagaccacaagactttaccaaagccaatagaaaaacgatgaactttaataccgcactttcgtgctgcccaaaaatggccatattcatgtactgaaaccaatacaccgataacaatgataaaagaacctaaagaccaaagaaatgacataataatctctacaagaaataaaaatagaaataagcaaaaaacggaactgccgccgttaaactgtcgatacgatccaatattccaccatgtcccggaataagttgactgctgtctttaataccgcactcacgtttgaacatactttccgtcaaatctcccactatggaaatcgctactgtagtaacagataaggaaataaaagacagacgttctaacacaaaaagatctgccggcacaagattaataaaaagtgcggcgaaaataccagcagtaatcaagcctccaaatgccccctgccacgttttccccggtgaaactttcggtgctaatttatgtttacctaatgctcgacctgcaaaatatgcacctgaatcggctgcccaaactaaaataaatacataaagcaatagcattaaaccatcgtaaggattagaaacgtaattgtccaaacgtaaacgtaatacagcgatgaaaaaagggatcaaagtgcagaaagcaaaaataaattgtaagaaagaggatttagcccaaatttttgccgaagcaggataacgaataacaaaaaataaggcgatgaaccaccaaattaccgccatcaataatacaggttcagcatagttttcaaacactctgccaactgttaaaaaatgtgcctcaccaaaaatccacaaaaaaataaaagccccaaacagccctgtaatcattaaacgccaaaaaaattgtttaacgccacaaaactgtgtccactcccaaatacctaaagcaacaacgacaccaagagataaagcaaaatagaaaggggaaaaccataataacgcaatcaaaacaaccacaattaatacgatagctgataatattcgttctttaagcactactcttctccatcattccgaactgccaaaacgacgttcacgttgttgataagctaatatcgcttgattaaattcctgttcattaaaatcaggccacaatgtatcggtaaaatacagttccgcataagcaatttgccataataaaaaattactaattcgttgctcaccacttgttctaattaataaatctactggaggttgtgaacctgttgttagatgatgttgaaaaatttgttcatcaatctcatcaatatgcaatttattttcttttaccaattgtaccaattgacacgtcgcctgaacaatatcccaacaaccaccataattcgcagcaatatttaaagtaagtgcggtattattttccgttaatttttctgctcttttgattttttcttgcaaacgctcattaaattgagaaatatcaccaataatttgtaatttaatgttatttttatgtaattttttaacttcaatatccagtgtttgcataaataaggacatcaaagcacttacttcactttcaggacggctccaattttcactgctaaaggcatacaacgttaaaactttaattccgatttttctagcataagaaaccgactctcggacagccttaatcccatttttatgcccccaaatacgcatttttccctgttgtttcgcccagcgtccattgccatccatgataatcgcaacatgctgaggaatattgtttaaatttaatggtgttttcgtcattatttaatcgatttttatcgaattgaaattcggttgcgactataccataagttgatacggcttgctatgaaaaggcaaataaacagaaaaaaaatcctcttttaatcggtaaaaaacataagtttagtcgtttagttttcaggcttaacaaataaaatctcaatgttttcatcattaatgctttaaagctgatattttcttttatcgccaatatcaaaatgtaaaggcattctccatttttgaatagaaaccataagaaaaagtaccgcacttacaaccgataaaatatacaccatataagtcaaattaaattgtaggcttaaccaaagtatcgcaacaaaaaatggttgtaaatttaatgcaaacacacggaaacaaaaatattctttgaatgctaatccccctaaagtcaacaatgctccgcccagtgcaaactccggtaaattaaatagttggcaaattaatgcaacccaagttgccatttgtaataacaagcggatattttttaaataaatatgcaaagaagaggcacataacgttgctgcaataagtataccgtaatgtgcaatttccggcttataaggtaaaagtgcggtcatgattgcggctaaagtgaaaccgcaacgatataaaataactgttagataatcccaatgatccataggggatttaatttgaggatctgccatattatgttcctgatgtacgtaaaacaaagctattagccaattctcttgcctgcttatctaccagcaatacatcttctatactggtaattacttggctttcaattttttctaataccgctgtgttaatttttgctatatccgtaaattttattctcttatttaaaaatgcttcaacagccatttcatttgccgcattcaaagctgttgttgcatattgtcctgctgagaaagcctctatagctaattttaaacaaggataacgttggtaatccggttttaagaaagtcaacccacttaattgataaaaatccaatggttcaacccccgcaaaagtgcggtgaggatatgccatagtttctgcaatcggtgtacgcatatcagggttacccatttgtgcgataaccgaaccgtcaatataacgcaccatagaatgaataatagattgcggatgaataattacttccatttcatcagcactggcattaaataaccagcgtgcctcaatatattccaaccctttattcatcatcgttgcactgtctactgaaatttttttgcccatagaccaatttggatgtgccactgcttgctcgggcgtaatatgttcaaacgctttcaaatctgtataacggaaaggtccccctgatcctgtcagtacaattttgctaattcccaattgcgttaatggacaaaaaccaatttgttgctgagcttgtggaggtaaagattgaaagatggcgttatgctcgctatctaccggcaaaagttgagccttattctttcgtacttcatcaataaaaatcttgccacaggttaccaatgtttctttatttgccaataggatacgtttacctgcttgtacagcggataacgtcggcaataaccccgccgcaccgacaatagccgccattacttgatctgcctcaggatgagcagcaagttcgcaaatcgctttttgtccgctcaacacttcagttttactctccaagaatgccaacttttctcgcaattttttcgctgcactttcatcattcattgccacaaagtgcggttggaattttataatttgctgtagcataagttcgacatttttaccgccaactaatgcaagagcttgatattgctccggattctttgcaataacggaaagcgtactggtaccgattgagccggtagaaccgagaatgacaagtttttgtttattattcatactattacaaatttatcaaatatataacaaaaaacgcagtaaaaactgcgttttcgctaaattaatcatattagaaatcaagcaattctttttctttgtcagccaaaatttcatctacttttttcacgaaagtatccgtgatcttctggatttcatcttgtgctttacgctcttcatcttcactgatttctttatcttttagtaaggctttaatttgatcatttgcatcacgacgcacattacggatcgcaattttaccttgctcaccttcgcctttcacgattttaattaaatcacgacgacgctcctccgttaatggcggaagaggaactcggatagttgttccagcagaagacgggtttaaacctaaatcagatgttaaaatcgctttttctaccgcactaatcaaagaacggtcaaatactgttactgccaaagtacgtgcatcttcagccactacgtttgcaagctgacgtaaaggtgtcggtgaaccgtaatattccacttgaataccatctaacaaactaggctgtgcacgacctgtacgaattttagcaatatgtgctcttaatgtttcaaggcttttttccatacgctgttgcgtatcttttttaatttcgttaatcacaataattcctttaaaaataataagataagtttaaaatctttgttaatttactactaatcgcaaattaacgtcccttctgttttacctaaaatgacattgtgtaatgcacccgttttgctcatgttgaatacacgaattggcatattatggtcacgagcaagtgtaaatgcggctaaatccataacttgtaattctttttctatcacttcagcataagataatttgtggtaaagcactgcgttgggatttttcacgggatcgcaatcataaacaccgtcaactttggtcgctttcaacacaacatcagcctcaatttcaattcctcgcaaacaagctgctgaatctgtagtaaaaaatggactgccggttccggcagagaaaatgactacccgtttttcacataacatttttatggcttccgaccagttgtatgtatcacaaatcccattcagttggaaagctgacattaatttggcatttacattggcacggtgcaacgcatcacgcattgccaaaccgttcatcactgttgcaagcattcccatgtgatcaccaacaacccgattcatacctgctttagctaacttggcaccacgaaataagttgcctccgccaagaacaactccaacctcgacacccaaccccaataaccctttgatttccagtgccattctatccaagatagacggatcaataccaaaaccctcgtcgccttgcaacgcttctccacttagtttaagtagaatgcgtttataaattggttggctcatttccttacccctttcaataacccagagacaaaatctcgcttattatagttcaacctgactagcgtgcaagtattcattgaaaaatacccctaattattttaaaccggttttaagtcaggattaatcttgaacgctaatttatttacacttggatactgacgttggatcaattgcaataaaggcgattgctgaaagaggaaagcttgtcgtacagttgcattaacgacttcaatccacatagtgtcagattcaaaattgataacacgataaaaccccttgaactcaataggaaataaatgttgtatttgttcatttaattcatctaacaacgaggctttatgaatcattttcatcaatggagaaagttccaataactcattgaaattgatcggtttgctgtatctcatcttgattttccaagttttaacctaatattttatgtagaattatgacattgtaacgaatttccgttacaatacgcagaaatttttgtggtgatgtaaaacgatgatttcaattaaaggtaaacaatatttttggtcgcaactgctattcagtgttatagcgatttttactttgccttttacacaaaattcggatctacaaaacatcaccaacaattatccgaaagaacaaagagtaattcagcaactttcccgtaaaatatcgaacattcaacaggttcagcaacaacaattacaacaaattcgtcatcttgttactgaaccgtcaattcctttccaaattgcaccgctctttttagttcagcaattgagctatcaagcaccaattcgtgccggtccgcaaccaattcaaatttaaatttatttcagtgccaaatattattaggcgaatttgtttatttaatttaaaaagaaaaatactatgttaagaactattgttacaaaaatctttggcagtcgtaatgaccgcattttacgtcgtttagctaaacaagttaaaattatcaataaattagagcctgaatttgagcgcttaaccgatgaagaattaaaatccaaaacaactgaatttcgtgcaagattgaaaaatggagaaaaactggaaaatttaattccagaggcatttgcaaccgtgcgtgaagctagtaaacgtattttaggcatgcgtcctttcgatgtgcaattaattggcggtatggtgttaaacaatcgatgtattgcagaaatgcgtacaggtgaaggaaaaaccttaactgcaaccttaccttgttacttaaatgccttaacgggaaaaggtgttcatgttgttaccgtaaatgattacttggctcgccgtgatgcggaaaccaatcgccccttattcgaatttttaggtatgactgtaggcattaatgttccggggttatcaccggaggaaaaacgtgccgcctatgcagcagatattacttacgcaacaaatagtgaattaggctttgattatttgcgggataatcttgcacattcagctcaagatcgctttcaaaaacacttacattatgctttagtagatgaagtggattctattttaattgatgaagcccgtacgccgttaattatttccggtccggctgaagacagttccgagttgtatatggcaatggataaactgattccaatccttatccaacaagataaagaagatactgaagaatatcaaggtgatggggactttacactggatctgaaaaataaacaggctcatttaaccgaacgtggacaagaaaaaattgagcaatggttaatggaaaaaggttttattaatgaaaatgaaagcctctactcccctgctcgtatttctttattgcatcatatttacgctgccctacgagcacacaaactatttgagcgtgacgtagattacattgtaaaaaacggtgaaattgttattgttgatgaacacaccggtcgtacaatggctggtcgtcgctggtctgatggcttacatcaggcaattgaagcaaaagaaggcgttcaaattcaaggagaaaaccaaaccgttgcttccatcacttatcaaaactatttccgtctgtatgaaaaattggcaggtatgacagggacagcggatactgaagcatttgaatttcaacaaatttatggtttggaaaccatcgttatcccaaccaataaaccaatgattagagatgatcgcactgatattatgtttgagaacgaaaaatataaatttgatgcgatcatcgaggatattaaagactgtgttgcacgcaatcagccggtattagtaggtacgatctctatcgaaaaatcagagttactttccaatgcactaaacaaagcaggcatcaaacataatgtcctgaatgccaaattccatgctcaagaagctgaaattatcgccaatgcgggatatccaagtgcggtcactattgctaccaatatggcagggcgaggaactgatattgtactgggcggtaactggaaagcggaagtggctaaattaaacgatccaacagaagagcaaattgaggaaattaaagccgcatggcaaattcgtcatgatacagtaaaacaagccggtggattacatattattggaacagaacgtcatgaatcccgccgtatcgacaatcaattgcgtggtcgttcgggtcgtcaaggtgatcccggttcttctcgtttctacttatccttagatgatgctttaatgcgtatttatttaacagaaggtaaattaaacttcatgcgtaaaatgttcacagaaaaaggtgaaggcatggagtcaaaaatgctagcgaaagtgattgctcaagcacaagcaaaagttgaagcacataactttgacggacgtaaaaatctgcttgaatttgatgatgttgcaaatgatcaacgccatgcaatttacgaacaacgtaatgctttactggataatgaagatattgccgaaactattcaggtcattcgccaagatgtcttcaatcatgtcattgatgaatatgtcccgccgcactctttggaagaacaatgggatattcctgcattagaaacccgtttgaagcaagactttgctcttgatttgccgttaagtaaatggctggaggaagacaatactttcaatgaagatgtattacgtgaacgtgttttaacagttgctatttctgaatataaacgcaaagaagaattggtaggtcaggaaactatgcgtaattttgagaaaggcgttatgttacaaactcttgatgaactatggaaagagcatttatcggctatggatcatctacgtcgaggtattcatttacgtggttatgcacaaaaagatccgaaacaagagtacaaaaaagaatctttccaaatgtttactgacatgttagatacattaaaactaagcgtcattactacattaagccgagtacaaattcgtactcaagatgaagtagaaaaagcggaacaggctcgtcaaaaaatagctgagcgtgaaaatgccgcaatgcaataccaaaataatgaaggaacatcatcacttcacgaaaaatcagaacataagataggacgcaacgaatcttgcccttgtggttccggaaaaaaatataagcattgccatggtagcaaagcaaaatattaattaatatggcggtggaaatttccaccgcactttttaggataaaaccatgataaaaccaacaatccaagttgccgctggcattattcgtaacgagtttggacaaatttatctaactcaacgactagagggacaggattttgctcaatcattagagttccccggtggaaaagtggatcaacatgaaacacctgaacaagcactggctcgtgaattagaagaagaaatcggtattcatgttctaagtgcggtgctttttgaacgtttttcttttgaatatccaactaagattattcaatttcatttttatcttgtcgaacaatggattggagaaccgtttggacgagaaggccaagaaggtatgtgggtcgatcaaaatgagcttgatgacagtcaatttcctcctgccaattttaaacttattcaacgattactagcagaaaaatagcgataacaattatcttctcgttatatcagctttataatcgtatacaaacaagagggcatttacaaatttagcattttacgtccgcaataacattcaaaattcttttatctgatataggatatttagtgcctagttgttgagcaaataaactaactcttaattcctcgatcatataaggaatttctttaacttcactcgagtgcggtttagatttcggcagttttgctaaaagttgttggtacgcatgactaacctgttctactctgagcattgcagcacgatcacgattaatatcttgtgctaatttatcaatacgcttatcaattgcctgtaaataacgttgaatatcagacaaacgcccataacctgttttcgttacaaattccggataaataagtccattcatttgtgtttttatatcagcaaaagcaaatgccattgtaaaatccatttttcctttcaggcgttgattgatttcaaaagtcaaggtcaggattttttcaacttgctgtgcaatttccactgtaacctcattcagattttctcgaataaaatcacgcaatctctcaaaatcagtttcattccaaaccaaaccgccaaaatcagcaataagtttatccacggcacaagcaatgcaatcatcaattaaatctaaaactcgtccgaaaggcgtaaaatacaagcctaacttcgatttgttcggcaatttttcatgtaaatatttaatcggcgaaggcacatttaatagcaacaaacgacgtaatccttgctgcatagtaacttgctgttcaagctctgtttcaaatagtttaatgccgactgaatctttttcatcaacaatagcaggataagccttaatgctaaaaccttgttttttctgttcataaaattgcggtagtcgagcgaaattccaaacatgaataccgctttgttcaataccactatctgcaacgcaggaaatacttttttgcactttatcttttaggctaaatttcaattgatctaaatcaaggctttcggcaattttgcctcccttttcatcaatgaccctaaaggtcattcttaagtgcggtggaatctgtgctaaattccattcttcaacttcaatctgaactccgctcatacgacgcaattcatgactaagcgtttctagcaaaggtttgtcggtttgcgttattcgacctaagaaagcactggcatagttaggtgcgggtacaaaattacggcgtaaagatttaggtaaagatttaattaaggcaataactaattcttggcgtaatcccggaatttgccaatcaaatcctttcatttcaacctgatttaatagtggcaatggaatatgcaccgtcacaccatctgcctctataccaggttcaaattgataagttaattttaattttaaattgtcttgataccaaaaattggggaaatctaatgtgttgatattggcattgtcttcgttcatcagaaaagacttttcaaaattcaacaattcaggttcttgttgtgcttttttcttccaccaactatcaaaatgtttttgtgaaacaacatcggtaccaatccgttgatcatagaaatcaaataaagcacgctcatcaactaaaatatcccgacgacgtgttttatgttccaattcttcaatttccttaattaatttttgattggcaaaaaagaatttgtgtcgggtattccaatttccctctactaaagcggattgaataaaaatttctcggctggtaacagcatcaatagcaccataattagcaagcctattagttacaatggggataccataaagactgactttttcatttgcaatcacttgtcctcgagactttgaccatcgaggttctgaataactggatttaaccaaatgtttcgctaacggttcaatccattccggctcaatatctgccattattcttccccaaagtttagaggtttccactaattcggctgctacaacccatttaggttgttttttaaataaaacggaattggggaaaatagaaaaatgtgcatttcttgcccctaaatattgctgtttttcattttctttcaatccaatatgggatagcaatccacttaaaagtgcggtgtgaatttgtgcatattcagcctcatgagaatttatgggcaaccccatttcacgcacggttaaacgaatttgatgataaatatcttgccattcacgaatacgtaaataatttaaatactcttttcgacacaagcgacgaaattgatttttgcttaaaattttctgttgctcttgaatgtaattccacaaatttaaataagctaaaaaatctgattttttatcagcaaaacgacgatgtttatcatccgcagattgttgtttttcttgcggtctttctcgaggatcttgaatagataaggcagcaacaataatcatgagttcatgtaaacaagaaaattgtaccgcacttaataacattttagccaaacgaggatcaacgggtaattgtgctaactgcttaccaatagcggtaagctggcgtttctctccttgcttgttttttttccattcaaatgcctgcaactcctccaagagcttcataccatcttggatatgacgtttatccggggcatcaacaaaaggaaaagcttctatatcatctaaacctaaggcggtcatttgcaaaataaccgatgccaaattggtacgaagaatttcaggatcggtaaattccggacgattattaaaatcatcttccgaatacaaacgaatacaaatcccttcagacacacgcccgcaacgacctttacgctgattagcggaagcttgtgaaattggctcaatcggcaaacgttgtactttagtgcggtagctgtaacgtgagattctcgccgtgccgggatcaataacatattttatacccggtacagttaatgaagtttccgctacattagttgccaacacgatacgctttaaattactcgggtgaaaaattttattttgttcttgtgctgaaagacgagcaaagagcggtaagatttctgtatgttttaaatctaatttttgtaatgcttctgcagtatctctgatttcccgctccccatttaagaaaattaaaatatcaccgactttctctgcctgtagctcatctaccgcatttaaaataccttgtaactgatcttgatcctctgcctccacaattggacgataacgtacttctacagggtaagttctaccggaaacttctataatcggggcatgattaaaatgttgagagaagcgttctacatcaatcgtcgctgaagtaataattacttttaaatcaggacgctgaggcaacagctgttttaaataacctaaaataaaatcattgtttaaactgcgttcatgtgcttcatcaataatgagcatatcatattgatttaaaaaacgatcagattgaatttctgccaataaaattccgtctgtcattaatttaatttgtgtttcatcgctgatttgatcatgaaaacgaactttataacccacgactccaccgagttccatatttaattcttccgcaattcttgcagctacggaacgtgcagcaatgcgacgaggttgagtatgtcctatcaatcccttctgcccaaaacccaattctaaacacatctttggtaattgagtggtttttcctgaaccggtttctccagcaataacgactacttggtgttcccgaataagtttctggatttcagcttttttttgattgaccggcaagttttgtggaaattccattttttgtaccgcactttgtcgttgtaaaaaacgaacttgtgcctgttgaatttgctgttcaatttccactatcaccttgttgatattcgtaggatgtttaagttgattcatgcccttgatacgagcaaacaaacgacgccggtcaatcgacatcatgtcgttaagctgtaccaataatgcctgctgttgtgtgctaaaaacattttttttattattcttcattattcttattttcaaatttagtcaatcatgtaacgctaaaaattatttatccagtttttccaataaacaaagacaaaatccccgctgcaattaacggtccaacaggaacaccccctaaaaatgcgacacccaaaatagtccctactaataaacctgtgagtagcgaaggttgcgtccccattaaattcacaccacgtcctccaaaccatgcaacaagcacacctaccgccatggctaaaaacattttccaatgaataagtgcggtccaattcggcaactgaaccttgcctgaaacgatgggactaagtacgccaatggtaagaataataataccaatattaactccatacttttccgtaaaaggaatatatttggctaaaaatgtttgttgcattaaaagtaaaatagttgcggaaatggttatggagctattattgcctagtacaccaagcaaaataaggctgactaacaataaagcaattgagttaaactgtaacgacattgaaatattcctaacggataattaattctcataaaacggtgctaattatagcaattttctacatgcttgcgactttttcgttatcaataaaaaagacattacagcaattatttaacaacattttaataattaaaaaacatctcatttacttaaataaaatttaaaaaataaacaatatattaaatataatttcaatttttagggtaaattttatttttttatattttaaaataattctatttgacctttcaattatttttgggtatatctaccccatcaaataaatttgtcatctttttaagtgaggatcttatgccccaaaaatactcaacgctaaaaaataacataaatatgttaggtcactttttaggcgaaacaatcagcgatgcacagggtagtgatattcttgatttgattgaaaatattcgtgtattatctcgcgactctcgttccggtgatgaaaaagcacgggaaaaattattagatacgctttcgactatttccaatgaaaatattattccagtagctcgtgcttttagtcaatttttgaatttaaccaatatagcggaacaataccaaacaatctcacgaaaacacatagaccaagttgcctccgatcgttctttagaggcactctttgaacgcttaaaagcacaaaatgtaccggcagaaaaagtcatctcaacagtagaaaaattattaattgaattagttttaaccgcccatccgacagaagttacccgccgttctcttttacataaatatgtagaaattaaccgctgtttaagccgtttggaacacgatgatcttactcaatcagaaagcacaaaattaaaacgccgtttaatgcaattaattgcacttgcttggcatacaaatgaaatccgtacgcaacgccctactcctgttgatgaagcaaaatgggggatagcggtaatcgaaaacagcttatggaaagccgtgcctgatttttgtcgtcaattgaatctctatttagagaaaaattttggtgtacaacattcagtaaacttagcacctgttaaattttcttcttggatagggggagatcgtgatggtaatccatttgttaccgcagagacaactcgccaagttttaatcatgaaccgctggaaagcggcagaattgtttttagcggatattcaagttttatcagaggaactttctgtagttcattgcactgaggaattccgtgccaaatacggtgatcatttagaaccctatcgtgtagtcgttaaaaatttgcgagcaaaactggtaaaaactgtcgcttattacggtgaaattttagaaaataaaccttcaaccatcaatacaaatgacattttgaccgatgatcaacaactttgggaaccgctttacgattgttatcaatctttacatcaatgcggtatgcgaattattgctaacggtatattgctggattgtttacgtcgtattcgttgctttggtctctctttgtctcatttggatattcgtcaagaaagccttcgtcatactaaggctctctctgaaattactcgttatattggtttaggcgactattcacaatggatggaagatgataaacaagcttttttaatccgtgaattaagctctcgtcgtcctttgctacctcgcaactggacgccttctccggaaacgcaagaaattttagaaacttgtcgagttattgcacaacaacctgaaggcgttatatcttgctatattatttctatggctcgcactgcctcagatgtgcttgcagttcacttattattaaaagaagctggcgtaacctattatttaccagtagttcctctttttgaaaccctagatgacctcaatgcttctaaagaagttatgactcaattatttaatgtaggctggtatcgtggtgtgatcaacaataaacaaatggtcatgattggttattccgatagtgcgaaagatgcaggtatgatggctgcttcttgggcacagtatcgagcacaagaacaactggtaaatctttgcgaaaaaatgggagtagaattaaccttgttccatggtcgtggtggtactattggacgtggaggtgcacctgctcatgccgcacttctatctcagccaccccgctcattgaaaaatggtctacgtgtaacagaacagggagaaatgatccgttttaaactgggtctacctgcagttgcagtaaatagctttgatctttatgccagtgcaattttagaagccaacctgcttccacctccggagcctaaagaaagctggcgtgcaattatgaatgaattatccgattcatcatgtaatatatatcgtagcgttgtacgtggagataaagattttgtaccttatttccgttccgccacacctgaacaagaattatctaagttacctctaggctctcgcccatccaaacgtaatccgaacggtggggtagaaagtttacgtgcaattccttggatcttcgcttggatgcaaaatcgcttaatgttaccggcttggttaggtgcaagtgcgtctattcgccaatcaattgaaaaaggcaataaagaaactattgaagaaatgtgtaaaaattggccgtttttctctacccgtatcggtatgttggaaatggtgttcagcaaaactgatacgtggttatctgagcattatgatctgaacttggttaaaaaagaattatggtatttaggtcaatctttgcgtgaacaactgcaagccgatattaaaactattctttctttatctcatgaagatgaattaatgtctgatttaccttggattgcagaatccattgccttacgtaatatctataccgatccgctcaacttactacaagtagaactgttgcgacgtttacgtgaaaaccctgaaaatccaaatcctgatgtggaacaagcattaatgattacgattacaggtatcgctgcaggtatgcgtaatactggttagtgatgaactcatcatacaaaagtgcggttaaaatcaccgcacttttttctacttctcacttttgtgctatgattatttcacttttacttatgagaaaatacgatgacagaccaaattaataaattagatcctgatacagcaattgatattgcttatgatatttttctcgaaatggcgggagaaaatcttgatcctgccgatattattttatttaacttacaatttgaagatcatggcggagttgaatttgttgaaacagccgatgactgggaacaagagattggcgttctcatcgatcctgatgaatacgctgaagtttgggttggcttggtcaatgaacaagacgaaatgaatgatatttttgctaagtttttaatttcccacaaagaggaagaccgagaatatcacgttgtgtggaaaaaataatccaagctcaaaattgaggaaaatttgcagttcaatagcctcttcgtataattgctgaacttccagttttgctatttaatacaaatcctagaatattactatttcaaataagaagagcggagaattccgctcttttagccttaaaatgcgttgtgattagttgaacatggcggaaatagattcttcattactaatacggcgaattgactctgccagcatacctgataatgttaatactcgcactttgcccaatgccttaatttccggcgtaaatggaatagtatcagttacaacaatttcatctaatgcttcattcgctagattttttgccgctgctccggagaatacggcatgagttgcataagcaaatacacgttttgctccccgctcttttaatgcttccgccgctttgcataaagttccgcccgtatcaatcatatcatcaactaaaatacaatcacgtccggcgacatctccaataatgtgcatgacttgggctacattggcttttggacgacgtttgtcaataatcgccatatctgtatcattcagcaattttgcgatagcacgggcacgaacgacaccgccaatatccggagaaacaacgatcggattttccaaatctgttttctttaacatatcatgaataagcaccggtgaaccgaatacattatctaccggtacatcaaaaaatccttggatttgttcagcgtgcagatcacaagttaacacacgatctactcctacgctcgataggaaatctgctaccacttttgcagtaattggtacacgggctgagcgtacacgacgatcttgacgagcatatccaaaataaggaataactgcggtaatacgacccgccgatgcacgtcttagtgcgtcaaccataacgactaattccatgagattatcatttgtaggtgcacaggtagattgaataataaatacatcacaaccacgtacattttcattaatttgaacttgaatttctccgtcactgaaacgaccaacagttgcatcacctaaggaaatatataggcgttcggaaatttgttttgccagttcaggtgttgcattaccggcgaaaagtttaatgtcaggcatcgtaaatttaacctctggaatttgtattgttaggaagacaaagtgtttgtttttgttgcgataaatattcaatcatttgatgtaatggtgaaatatttgttccctgagcaacaaaaccaacgtatttttcaggtttatcaagaaatgcagattgtgccgcctgttcgttagcaaattcagcgaaaacacaagctccagttcctgttaatcttgccggtgcatattgtaacaaccagccaagggcttcttcaacctctgaataatgatttaaaacaactttttcgcaatcgttttcatattttgttgttaataattccgctaaaggtcgttttggggtattgcgaggtaagttaggatctttaaatataatagctgtagaaatagatgtttcgggttttaatactaaaaaccatttttgtggcggttgacaaaaagtaagtttttcaccaacaccttcggcaaaagcggcttttccatatacaaaaacaggcacatcagcaccgagctgtaatcctatttcagcaagtgttgagagtgaaagttgtgtattccataaatagttgagtgcaacgagtgctgtggctgcatttgatgaccctccgccaacccctccgcctattggcaaaattttatctaaatgtaaatttgcccctaatgtacaccctgttttttgttgtaataatttagcggctcgatagattaaattatcctcgttttttagatgaggtatttcgggtgttaagattatttttccgtcagtgcgtatctcaatacttaaccaatcgccaaaatttaaaaattgaaataaggtttgcagttcatggtaaccatcggggcgttgagaagttatatataaaaacaaatttatctttgcagggcaaggaaaacgtaatttttttccttgtatttgcgatgataaaagtgcggtcgaaaattgatagtttttcattaatatttccaattatctatcctaacttttaaggtctgctcactacttttcagaagaatatctttgggtaatggaatgctttgatctgttcgatagttgagatagtcagcactccaaacttcaccctcaactgaataagtaaagcttgctaataaatgatttatgccgacctgataatctgaattttcatctggttgaccttttagccagttccctatttgttgtaatggaatagagataccaatcatttcacggagcaagttgttgatatcttttgttgaacgctgatttcctttatggtctgaaacagtaataccgaaaggtgaaacttcaaatttaagcattgaactgctgaaagctgatgaaagtagtaaagaataggattgcggattgttatattgccaagtaaagcgagtggaaaaacgttgtttattgttaatataacccaattgtccttgagcttgatagtgttttatttgcttaattttttgtaggtgttgttgccattttttatcatttttttctatatactgaataccttgcgggcgttcgctggcaatatctaaagtacaagcactcagcaatatcgttaaaataagtataaaaaaaggtttttgagatgttttcatgtgtcggactcgtaaaaatatcgaatattttaaggtcttacataagattagtaaagatacaaaaacttttgattttttgaccgcactttgatctgtttattaaaagatgttaatttaaatttatttgaagggtggcttacttcaatttttacaatgatctctttttaaagaaacacaatgaaaaaatcatttatctcaattgcggcgttagacttattgggagcggtttgggttggtacttcttggtatacaggtaaagtagcagaacaggaatacaagacacacttagaacaggttaaatcgaaattacccgcaagtccgaacccgatagctcatctacatgctaagatcaatgatttacaatttaatggtcgttcttttactgatgaagatattaaacatgtaataatgaacagcggaattggggataaattaggtttacagtaaattgtaggttggctgatttttatactctcccaattttttctcaacaaaggggattatggagaaattttaacattgaaactcattgcccaaagcaagttgtttggaaataactttatacataatggtgattatagttgctatttttttgaagacgaacaataatagtgtgccgataagcaagaacaaatgatttttgcgaggatattttttgataaactacgatatggttatttttccgtatcgtagttttgttttacttaaaaaggaagtgtacaacaatgaaacaaattccaatgactgtacgtggtgcggaacaattaagagaagaattagattttttgaaaaatgtgcgtcgtccggaaattatcaaggcaatttcagaagcacgtgaacatggcgatttaaaagaaaatgcggaatatcatgcagcacgtgaacagcaaggcttttgcgaagggcgtattcaagaaattgaaggtaaattagcaaattgccaaattattgatgtaacaaaattacctaataatggtaaagtgatttttggtgcaacggtcgttttgttaaatattgataccgacgaagaagtcacttaccgaatcgttggagatgatgaggcggatattaaatcgggtttaatttctgttaattcgcctattgctcgcggtttaatcggcaaggacgttgatgatactgttgtcattacaacacctggcggtaaagttgaatttgaaatcgttgaagtagaatataaataacataacactttgataggaaaaaaatgggcttaatgcccattttatttgtttcagttattggcgaggtaactgaattttgggttcattacttggacgataaagtacaagaacatgccctatagtttgtaccgcactggcttgcgtttcacgtataattgcctcaataatcagctgttttgtttcacgttcagcaccagaaattttcactttgatcaattcgtggtgatttaatgcgttgtcaatttcagctaaaaccccttctgttaaaccatttgtgcccagcataaccaccggatttaaatgatgtgctaaaccttttaaaaattgtttttgttttgttgataatgtcattggttacccatcctacataattaaaagtgcggtcaatttgataacaatatttcaattgcctttatctcgaagattttaaccataaatccaaaaaataaaaagaaggaatagttattttataggatagttaaaacactttccggcggtcgtcctattttagctttatctccatttactacgattggacgttcgagcaatgcggaattttgtgagagtgcaatcaaaagttgttgttccgttagctcctgactattcaatcctaattgtaaataaagatcgtctttcgtacgcatcatctcccttacagacgtaattcccaatttttgagctaacgtttgcaactcttcaacgttgtaagtttgctgtagatataattcaacgtcaataagaatggattgttgttccaataaagccaatgtttcacgactttttgaacaacgtggattatgataaattttaaccgtcataaatgctcctttgctcagatacagttcaaatatgcaaaattttaccttataatcacccaaaatgctcattcgttaaggataaattatgattgaaatgttaaaaaattggtatcatcgtcgctttaccgatccgcaggcgatggcacttttcgctattttattctttggatttgtggcaatttattttttcaatagtttattggctcccctcctgattgcgattgttttagcttatttacttgaatatcccgttcgcttattacatgaaaaactgaaactacctagaattttggcgacatctcttatactcggtggctttatagcaatcacatttgtcatgacatttattttgatcccggtactctgggcacaaaccatcaaactggtcagcgacttaccacacatgttcaatcaacttaacgaatggttactttctttaccggagaattatcctgaattagtagattatcaaatgatagatgcgttttttatttcatttaaaaataaaatattaggcttaggtgaatctgcacttaaactgtccattgcctccttgttaaatcttgttaccttaggaatttacgcttttcttgtgccattaatggtatttttcctcctcaaagataaaacggaattaattaactatattacaaactttctgccaaagaaccgcactcttgcctcaaaagtttggcgagaaatgcaacaacaaattgccaattatattcgcggtaaattacttgagattttaatcatagctttagtcagttatgccatttttctattttttggtttgaattattcattgttactggcagttgccgtgggattatctgttttagtgccatacattggtgcagttctggtcactattcctgttgctttagttgccatgttccaattcggtgcaaccccaactttttggtatttaatggttgcttatgtgataagccaaatccttgacggaaatttactcgtgccatttttattttctgaagcagtgaatttacaccctctcactattattatcgccgttcttatttttgggggattatggggtttctggggaattttctttgcaattccattggcaacactagtcaaagccgttgtttcatcttggccgtcaacagaataaccgataaggaagagtttcattgaaagggctatttattaggattgttttatccatctgtttatcgctttgggcaatagatatggttttcccttggcaacaaatagtgagatcaaaacagaattaccatactacaattcaagagcgacaaaaattgattgtaggaacaatcaataatccggtgtcttattttatcggtacaaacggagaaacagggctagaatatgaattaagcaaggcttttgcaaattacttaaatgttgatttagaaatgtttcctctaaatagtgcggacgcattatttcaggctttagcacaaggtaaaatagacattgccgctgcaagtttattttatcaacaagatagaagtgaaaaattcaaactaggtccggcatatcacgctgcatcttggcaattgacttatcgcaaaggtgaacgtcgtcctatcacattagaaaatttatccggcaaattggttattccggctaattcggcactgaataatattctgctggcaaaaaaagaaaaatacccttctttaacatgggaaaccagtgaactaagccaagaggaactcttatttcaagttgctgaaggaaaaatagattacacaatcgctacctctactgaagtatcagttaatcagcaaattaaacctcaaattgcaattgcctttaatgtgactgatgagtttacagtacattggtacttatctgataaggggtcttcagaattacaagccgcactattagacttcatgaactctgccattgaaaacggcttaattgctcgtattgaagaaaaatatttcaatcacctcaaccaatttgactatgttgatactcgctcctatttgaatgcaattgaaacagttttgcctaaatatgctcctttgtttgaaaaatataaaggtgatttagattggcgtttattggcagccatatcttatcaagaatcccattggaatccggaagcaacctcaccaaccggagtacgcggtatgatgatgttgacaaaagcaactgcagatagaatgaatattactaatcgtctcgatcctgaacaaagcattaaagccggttccgaatatttacatcttctgctcaaacaaatgccggatactattttaaaagaagatcgtatttggtttgcacttgccgcttataacatgggattgggacatttattagacgttagacgcttaaccaaacagctgggaggaaatccggataattggttagaggtgaaaaaaaatttacccttattagcacaaaaacgttattttacccatcttaaatatggctacgctcgaggctacgaagcgtttcaatatgtggaaaatattagaagatatatgaacagcataatgaattattatcggcttcaacaaaaccaacaagatcggtatgaaaatgaaaataatgatgtcatttcaatacaaacacaacaggaacaactatgagaagaaaaacctttttaaaaaaaagtaaagtcacgctatatcgtaccgcacataaccgagcattaagaattaaacgcttaaaaaaacgtaaagcccaacaagcagcacgacatgcccagcaattcgtcatacaagaaatttgttgctgatttttcgtgctgtaaaatcatatcctttagcatatggatataagaccaatcagataaaaaagcggaatttccaccgccctttttgctttacataacacaccctaccaaaaccggatcgttaaattctgttttacagtagcccttaattaacaaaatattcaaggcaagagaaaagagaaaagagaaataaaaagaaaaagaaaaagagaaaagagaaataaaaaatgattgccttattaataaattttgtaatagaatctccgaaatttattactatccgcttgacaaacaaaaataacatgaatttacagcctacagcctacagcctaggctaacgccttkttryaaaycttgcaaaataaattttaaaaagtttttaacttttcatcatacccaaatttccccttttaaacccctttgcgaaaatatcattcgtctttttctgctttgccttaaaaagcaaggcatcgccgatttatacctcattaatctacctaaaaaacaaaaagtttaatccattcacaaccataaaaaagtgaaaaaaaatcaacaaaataaattattaaataacccattttaaaagattaaagagaataaaccatgaacaaaatcttcaaaaccaaatacgatgtaacaacaggtcaatgtaaagccgtgtccgagttggcgagcaatcgccaaatagcaagtagctcggagaaaaagccaaagtgcggtgctaatttgaaaagaacgagcttgtcagaaaacttactgttcaacatgctgatcagcggtttggtgttgtttgcgtatcccgcttgggcagcagcggctcaaactcaagttaacaatgataaagacatcaaaatagatggtaataccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgctcaacgagtagtgctcggtaataaagcctatgccatcggtaaccaagcggtggggattggtggtgatgtattcgcccaaggctattcctccatcgccatcgggagcgatgatatcggcgaaacggctgatgagaaacaaaaagatggaagtggaaatgataaatactccaaatacgccgtccccctacctaaagccatctggcagttgtttgttgatgagggagatcattttaattcaaaaacgaaaaatagctatgcggttttgcaaaacggtaatagtgacggtaccaacggcaaagccaaaaagagttcagagttttatagcaatgggaatggtagtggaaaaatcgacagaaataaagaccctgctaaatgggaagaagaatatgcaaaatttaataaagacgcatatgaaaaatacgtcaatggcacccaaaacggtagtagcaataaccccaaaaacgtctactcccacacttgggcgaaagggcgtggggcgattgccatcggggcaaggtctatcgcttacggcgaccattctaacgccatagggacacttgctattgccaagggtaactactcttccgcctttgggacgggaaccatcgcctttgaagatggcggtatcgccgtggggaacaatgcgtacgtttatcgcgaacattccattggggtgggaaataacgtccaagcaatacaaaaaggctcgatggttttcggggtcaattcctatgctggtggtagcggttccttagcgttaggggaatatacctttgcgaatgtcaccatggacgatgagtttaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaaacaatattacaaagccaaaacaaaactacaacaaggaacaggcgaaaagaaagctgaacaatccaaagacagcaaaggcacttataaccaaggtgggatagccatcgggtcgtactctgtcgccttgggggacaatgcacttgctttaggaagacacgcctacgccaaagaagacagcacggttgccatcgggaacttcgcctttgcaaaagatgaaaacgccttcgccctcggcaaagccgcccgatctatgggtaaaaattcattggcgataggtgtggaagcggagatttggagtccagatgcggttgcaattggcacaggctctaaagtgcaaaaaaatgccgaaggtgcggtcgcaattggagatggtgcttctgttgaaacgggtgcagatggttctattgccttggggaaarrttcaaargcggcagmgaagaaacaagcctttaaaacccaagaagttaatgtgggtacaaaaggcttgatgtttgactggggcagtgcaggcacctcagaaaatgatcaagaggacaagaaaaaagccgtggtcagcgtaggaagtgcaggcagtgaacggattattaccaatgttgccgctggttctgttatgaacggttccactgatgcnatnaacggcggacagttgtatagcgtgattganacntttggtaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacaacttggcgacacattaacattcaaaggcgatgacaagtatatcaaggcgactgtagaaggtgatgctattaaatacagcgtagaagtggcaactaaaatagatgatgattcaacctcatctagttcaggtggagcaggagcaggaacamcagatccmaatgataaattagtgaccgcaagtgcggtgaaaaattatgtcacgacaaaatttggtgcattaagttcaacgttgaatttagaaaccgatcaaccaactgatggcagcaaaaataaaggttcaatcaatttaaaaagtgataccttaaaaattactggcgatagtaatatcacgacttcatttgtgactaatggtaaaaagaacatcagtataaaacttaaagaaaatttaactaacatttcttccataggtaaaggtactaatggtaccaaaatcacatttgatgatagcaaaaaagaaatcaaacttggctctgtttctgtaagtgtaaatagtgagcataaaatagtaatcggtgagggttcaaaatcagattcacaacatacacttgccatagggaataaagccataataggtcaaaatgcaaaaggctctatctctatagccagtctaacaaatggtgagcaggggaatatatcaaacgccgaatgggcggtgtctatcggtaataaaaacagcatcaccggcggaaatgacattgtcgccttggggtcgaatattaatgtaagcggttctgatggtaagagtaagtctgtagttgcaataggtaatgggacacaagtaacaaatgggaaagaatcaatagcaattggcgtagcaggcaataccaaaatagaaagtgctgaatgggcggtcgctattggtaataacaccaaagtatctggcggaaacgacatactagcattgggttctaatatttcaataactggaagtaataatggaagtgtagtcgtactaggtaatggtgcaaaagctagtgccgcagaaaacagtgtggttataggtaaaggagcagaatcaaaagcccaaagtgcggtggttattggggaaggtgcaacggttgaaggtgatgctggcgattctgttgcattaggtaaaaattctaaggcgaaaactaaaaaacttgctccgagtggattagatggtaatgtcggaactaattcattaaaaatcagttggactgctggggtttctagtggcrcaattgataaaaaatcagtattcagcattggagatgcaaatagcgaaagaataataaccaacgtcgccgcagggacagtagataatagttcaactgatgccatcaatggcggtcaattaaaaagcgtcattgatgtgtttggtaagttagcatttgatgttctcggagcggaaaaagaaacagagaaagaggcagataaacaaacagttaaagacggatttaaaaaatcaacatttactgctgttcaatataagagagacccacaaccacaaggacaaccacaaggacaaccacagcaacaagcaaaagtaccaatgacattcagagaagcgattaatgaaagcattgctgctattaacaagggcttgatattcaaaggcgatatgccaagtgcggtaacaaatggtactcaaaacacaccgcactatctyggttcgacyattmakattgtgcgtttggyaacgcctgcgaacactggcacaacgactacacagycagctacaactacgccagccatcacggcgtatagtggggagaatttaatcacgcaatatagcaatactrrtggcaacgccaaratcgaaatcggktttaaaraygcaccgacatttagcaaagtaatgcttgctaaagaacaaacatataatggcggaagtggaactggcggaagtacagattggaaaaaagaactcatcactaaaggctaccttgaacaagcgttagataagtttaagtttaaagtatctactggcgagggtgatgataagacttttgaaatcggtcgtggcgatacgttgaagtttackrstggtcaaaatattcaattgactttagcgaagcaagatggggcaacgtctggtagtagtgcaacagcaccagccgctgcaccatcaccagcgccagcaccatcaatagcaagcggttcgtcaagcgatgtaagttcaaatagcggtggttcaaatggtatggcttcgtcaggtggtgcaaatggcggtggttcaggcgatgcaagcatggctacgacgggaactgctccaagcacgccaaccagcacaacaagcgatacgagtacaccaaccgctactacaccaacaacggcagtgttaaacattgccacaactagcgatttaagcaatatcagctcgatttcctcaccgcctaaaggagcgaatgcaggtacaggcggaagcggaagtgcgggcggaaattcaggtactggttcaaatgaagaagtcgccaaacttaccttagaagccgagaaaggggcgactttccaagtgggtagcactggtgckaaagtgaawatcaatramragggtattwcacttacsccacaaggrgcraatarcacaggmggakcaartggagcaratccatctgaywcascatcaatcactattaaagcaggkgcaaaaccggcggatccaaaaagtttagattcacttgatcctaataacggaccttcaatagagttctcagccaagaaaacaagtgatggtaaaaccattggctcaggcaaaatcaccggtcttgctgatattaagtcagatgaaaaagacggcaccgttgcaaccaacaaaaattatgttgatggcaaagtggaagatctgaacaataaccgtccatttgatttttatttagrcaaggaaaaagtcgtgaaagrwaaagayggmaawttccayaaagcarrcraacctamyraammacttkmwgmcgawgawrygaaaaaagtygtkatcaaagccgaaccaagcaccgcacctattgggattagcaatgtggcgagtgggttgggattgcctgcccctgaaaaagatgaggaagaaaagaaaaaggcacagcaaaaaaacactgagctaacaaaagctgttgaggaaacagtgaaagtaatcggtgataaagctaaagaactttcaactactgctcaaaaagtaacagatttaactttagcagccagcggtttggaaatggcgatgaatgcaatgcctgagggcgaagaaaaaatgaaacttcaaactcaattggaagaaaataagaaaaagctagaaaaagccaaagaagatctaggaaaagcaaaaactgctttaaccgaggcacaaaaaggcttaacaaaagccaatgctgactatgaagccaactacaagggttatgaaaaagtcgctgccttagtcagtgccgatagtaaagccgaattaaccaacgtagccacaatcggtgatttgcaggcggtagcgaaatcgggcttgaaatttaaaggcaatgatgacatggaaattcacacagcattaagcggtacttttgcgattaaaggtgaagaaggtgcgaatggcaataaatttaacagcgaccgcactgctgccggtaatatcaaagtggaaatgtctcaagatggcaaagggcttgaagtcaaactgtccgatcagttgaaaaatatgacctcttttgagacacgtgaagtggaggggagaaaatctacgctaaacagcaatggtttgatagtggtcaataaaggtgcagataacaaagtcaaatcagcaacatacggtgcggaagcgatggtgttgtcgaatcaagaaaacggcaataaagccgtggtgaccgctggcggtgtccattttgccactacccaagccccagcgacaggggctcgtgcggggacaggcgtgattacaggcttaaaagacctagacgcacgctcgacaggcgacatggcaaccaacaaaaactacgtggacgaaaaagttggttccgccgtcaatcgcttggataatgcgatcagtaccactaacagacgcttgcaggcgggtatcgctggagcattggctacaggaggattgccgataacggtgatgccaggtaaatctatgttggcagcgtcggctggctcgtataaggggcaaagtgcagtggcattaggctattctcgcatgagtgataacggcaagataatgctacgcctacaaggtacaagcacttcaacgggcgatgtcggcggttcggttggtgtrggstatcaatggtaggrttctaaacgccagmaaaaytcaccgcacttattgataagtgcggtgggtttggtagggatgattagttaaatctcaccaaaacagtgaacaatgcactgtcccaaatattaaactaatttattctcttatgtctcaggcttaagatctaattttgccatgagcaattgatcgccatcttcttcaggattgactgttaccaataatttgtcaccgtaaaaaatagaattggctcctgccataaaacacattgcctgcatttcttcagacattccttgacgaccggcagataaacgcacatagcttttcggcatggtaattcgagcaacggcaattgtccgcacaaattcagtccaatctaattcttgagcatcggcaagcggcgttccctccacttttaccagctgatttattggtacggattcaggctgaggatctaaatttgctagacttgcaattaaacccgcccgctctttgcgagtttcattcataccgacaataccgccacaacatacttttaaacctgctttcctgattttaccaagagtatttaatcgatcatcaaaatctcttgtgccgataatttctttataatgttcaggtgcggtatcaatgttgtgattatagtaatccaatcctgcctcttttaattcttccgccataccgtcttgtaataaaccgaaagtgccacaagtttccaaccccagatcttttaccgctttgataatttcagtaatttttccaatatctttcggcttcggtccacgccaagccgctcccatacaaaaacgccccgcaccacgagatttagctattttcgctttttcgacaatttcctccacacataataattgctgattttgtacgccggtatgataacgtgcagattgtggacaatagctacaatcctcagggcatccgcctgttttaatagacatcaatgtcgaaagctggatcgtttgtggattaaagtgctttcgatgtacctgagccgcttgatacacaagttctaaaaatggtgtttcaaataacgcctcaactttgcatacagaccaatatttaacgcaaggatgcggtgttaaagagggaatgttgatagttgtgattgtcatattcttttccttatataaagtgcggtcaatttcaacgaggaatttccctctctgttgcttgaccattttttatttcaactatgcgatcaattttatctatcacttcgctcagttgatgagtaaccaataataacgttaattgtttttctctacagaacttatcaatcaatgtcaacatttcctgacgtaaatgaggatctaacgctgaaaaaggttcatcaagtaataaaatcggtttatctcgtaacaaacatctcgctagagcaactctctgtcgttgccctcccgacaattctttaggtaaacgtgataaaaaatccgttaaacctaccgcacttgctactttttccagttgtttgatttcttctttgctcaacttcaaatccgctcttaaaccgatagcaatattttgccataccgttaaatgagtaaataaattatgctcttgaaacaaaatggaaacagggcgttgatgtggtgcggtataagtatgattttcaccatttagccggatttccccttgcttaaccggctcaaatcctgcaattaagtttagcaatgtactttttcccgctccgctttcaccaataatagcaatcttttcgcctagacttatatgtaaatcaaagtgcagagaaatattgggataatcaaaaatagtgtttaatttaatcatctttttttattcgttcaattaatataaaaatacatgtacaaaaaacgagtaacagcaatgcagttactgcaccttcgtcagagcgataactacctaattgttgatataacaaataaggcaaggaactaaaatcctgattcccgaataaagctatggcagtaaaatcccctaaggaaatagcacaagccagtgcaaaagcatatttaaatgatgcttttaaattatgccattcaattaaataaaatctattccaaccttgaatagccaaggattgcgatagtttttcgtaatgttgcatattgttgtacatcggtaactttagaacctgtaaaacaaaaggcatggcggttaagccattacatagtacgactaaagcaaataaatgatagtgggagaaatccatttcccttaagcgaataaataaacctactgaaataaccaagacaggaacagccagcaccagcattccgctatttaaaatactctgagataaaaatgaataagacaaatagtgtaaacggcgtgccagtaataataatgaaacggaaaataacatcgctaaaatcgctgataaaggtgcaatagctaacgaataacctaaagcctgccaaagttgtgattgctgccaaatttgccataaactttgtgcttgaaaagcggagaaaacaatatttattaaaggcaagctgatgaacaataaaacgcaattgatataaaaaatttgccagatttgtaccgctcttgactgcttttctaaccaaatatttttactatgcaataacacttgtggcgatttttgccataggctacccaatgcaaacagcacacaacaaaaaattacttgtaacaacgcaaataaagccgacttcgccaaatcaaattcaaataaaacggcttggtaaatagccacttccaatgtagtgtatttaggaccgccgcctaaggtgagaacaatagaaaaactggtgaaacacagcataaaaatcaagccaaaaaccggtaataattgttggcgtaaatagggaaattcaatcaaacgaataaactgccaaccacgaagattcaattgtgatgccagttgcctttgctgagtgggaattgtttggaatgtttgcaaaaacattcttgctgctaaaggaatattaaaaaataaatgtgcaattaaaataccgcttaaaccataaatatggggttgccacgttatgcctaaaaatgttgttaatttaaccagccagccgttatgtccataaactcctgtaataccaaaaattacaactaatgcaggcaacacaaaagttaacgaaaatagcttaagaatcaaagattttgctataaacctttgatagaaaaaggctcgagcgaataataagcccaaaaaaacggaaagtaaggaagataaggtagcctgtccaaaactaaataaaataacttgcttgatgtaatcatctcgtatcagttccgtccatttataatcagtttcaacagtaaaaataccgctcaataccagaccataaaatgaaacaataaataaccacactaccaatccacttaatgagctgattggtaatgtggaaaaataacgccatgcttttaacaaattacttcaccaaacttgcttgccattgattaatccatttttttagttgctcagcagaaatattggaactgtcaaacacatttgttttgagctgatactgttttaaggcatcataatgtggctcaatagggtcagaaatcacagataacatcacattatttttaacgatatgtgtctgtgcttgcggtgaaatcaagtaatccataaataaatcgccacaggcattttctttgtttgctattttggctgctaattcaacttgtaaaacgccgccttcagcaaaatctgtcgcttggtactgatctttttgttcatttaataaatgataaagtggagaggtgctataacttaatactaaatccgcttcaccttttaaaaatgccccataactttccgtccaacctttaccgacagtaacagtatgtttagctaatgtctgccaagctcgatctacctcttgttgtggatacaccaaatttaaccaaatgattaatccccgccccacactgcttgttcgaggatcctgataaataactcgtaaatcctgacgttcaaccagctcttgcaaagattgcggtggatttactaatttagttttatcataaataaaagcataatgcccgaaatcataaggtaaaaaacgtcgatcttgccaagaaatcggtaaagaaagtctatttaaatcaactttatgctcactgaataattcagacttaattgcctcttgtagtaaatgattacttaagcctagtacaatatccgctttggttttcttaccttctaaacgcagacgattgaacaatacacctgaactgtcaaaggacacataatttacccgacattgcggatattgttgctcaaatccttgtttcacctttggacctgctccccaatcggaggaaaaacttttataagtataaacggttaagccttgtgctgatttcgcttccgcttgagcaaaagagcaaatagacatcgcagaaagtgcggtaaaaattagagtggttttgaagttcattacttttctcctgtttgaataaacacagcatgataagtaatattgacttgattggaaaaagaaaggagtaagaccattagtttcctacgtcagtattarctgtatcaggttcacgggtatyatctcagctgttatcagcaccccgactaagtcggacaatagtctattatatttttgttgaaaataacaaggaattttctcttaatctttgacttaacttcaagaacttattatgtctaatgtaatgtacaatttttttatcaaacattttccggcacaatacaacgctacactttttcaagaaattcaaaaaaataaacataatcaaaaaactcaacttgagcaagttatggattatgtttatcagatttgtcgttttgcttgctcatatacaaaaaccgaacaccatcctcttattaagagtaaaattagaattttaagcaaaacaaaaacgttcccaattagtaggcaggaagagtttcaagcctgtctaaaaagaaacgttttgaagttatgtcagattaaaagaaattatttaatcaattattttttttgtagttgaccacattaaagaaacgtcttccttcttgctttccggcatagccacttttttgccaaaaggcattcttcaaccaattctcaaactgctgatgagttggaaatgtcatttcaccaaaattcggatcaaagaaagtaacttttgagccgtcaaccgccgcagatacagtgtgagatcctccctcaagattaatggagattttcttaacaccggcagtatcatcgcctgtatccaaaatcgcttttactaatgaggatacatcattttttgatacagttcctgatacttcatcacgacgaacaaaatctgctacttttttctctttcggaacaacaccttgctcttgcaaccaactatctgtcaatttgaattgttgagtcgcactaccgctattaataaactcagtttgaagttttttaatagaatcaatagtttcttttttcaagtgtccttttttaccaccttcataaagggtattaaagaaattctcgtcggttggattaacattttttgcaatccaatgtgcacaagttgattcacacacaccattttgtgtttcaatgtgttttacaatttccttgtaaacttctcctttagattgggcaaacttaaagcttacttctccaccaaactcttcaacggaagaacgtacagcatcaattttgcttttcactttcaaaggctgaaattgatcctgaatgcgttgcaataccgtgcgttgctgttccactaaatctttactgctcaccaaatcactaactggtttcgcttttgcctgttccatttcagtaactgtttcagaaactgtcgcagatctaactgttccggaactcaaagcagccgaattttctaccgcactttctgtcaagtccgtagaagtgcggtcagttttttctaaattctgctcgttatcttccttgcttcctttttttgccaactcttttaaaaactcaactaccacttcactgctcgttgcggatttagttgatgctttcgtttgaggaataatctgcggttcaaactcatcactaaatttggtaaatgccggataacctgcatcaagtaaaattttatttactatgactctcgccatacgtccattaccttctgcaaatgggtgataagcaatcaatcgctgataaactaatgccccaactacactcggctcaatcccttcatttttcgctcgattgataaaatcaaccgtttccgctaattgaatttttgccgcttcgggactagaaaataccgcattttctttggttaaattctcttttttataaagtaaacgaccttctccctcatccggacgtaatccgtgattaagattctcgatcatctgcactgtcaaaggtttgccttgactgttttgtaagaaatcctctattgctgtcttcaactgttctttcaactccggtgtacgttgaatggttttcgatgtcgcagctaaagcttctgtgatttcatttgtttttgttgaaagatcctctataacctttgttttcggtaacgttttcaccaaatcttgaatttctgaaaactcctcaacagaagggcggaatgtgattgccttattaatacgactttctactttcttagctccctcggtgagaatatcatcaaattcaggtaaatgagacatttgcttaactgtcgcttcaggaattgatttcttcgaaatctctcttgcttcatctaaaaatttctcatttttcaatacattactttcaaaattagcatttcgatcatcttctaaagaaattaatccttttaagttcaaattatcttccaaatcttgataattgactttattcgctgtctcatctcccgctacaggtttcgcaccgctcttacttccggtgaaaaattgtttcactcgttggaaaagtgtggttttttctttttctacacccgtagcaccctctgatttctctgccgcttttttatttcctccagcagcatcttttagttctgctggtacagatgacaacggtgcaacttcatttacagaagtctccactttcggaacagatggtaactgaccacctgctttaccttgttccggctgtttaatggtcaaactgtctgcggattgtgtgttttcgacttcactaacatctttagacttcaacgtaacaggcgaagtcgcttgtccgttttgattattcgcacctccctcttgcggagatgattttttacctaattcagtcaaaaactctttcacaacttccgcacttgttgctgatttagccgtagcttttgtttgcggaatgatctgcgtttcaaattcagaactgaatttagtaaacggcggataacctgcatcaagtaaaattttatttactacaactcgagccattcgaccattcccttctgcgaacggatggtacgcaattaatcgctgataaaccaaccccgctaaaacacttggttccacattttgcttgattgcttggttaataaagtccactgtttcatttaactgaatttttgatgcttgcggactggaaaataccgcattttctttagttaaattttcctttttgtaaagcaaacgatcgctaccttcatcaggacgtaatccatgatttaacttttcgatcatctctacagttaactctttgccctgactacttttcaaaaattcttcaatcgcaccttgaacttcttctttcaattttggattacgttgaattgtttttgacgtatctgctaaagcttctgtaatcgctaaagtttgtgcattgagatcatctaccgcacttcctttttgtatatttttcaccaatccctgaatttcattaaattcatcaacagacggcttgaaagttaaggcatcattgatacgtttctctactttcttcgctccctctgttaatatttcatcaaactccggagaattacccatttgtttgattgtagcttcagggatgtatttcttagcaatctctcttgcttctgccaaaaattcaggatttttcaatacattttcttcaaaagaagaaccacgtttatcttctaaagccaataaatttttcagatttaagtcatcttccaaactatcataatttggtttagaagcagtttcctgttcagattttgcctctttagcttgtgatttattcgatttcgcaaagaagaaatcttttactttcgcaaaccaagatttctcatctgattttgcttttggcgatacgccctctgctccttctgattggagtttctgattaccgttattgttgcgattactttcagccaacgcacttcttggtgtacctaatacagctgattgtccattttccgcaactgtttcattgcttaccggatcgctcaaatttgatgggcgtggcggtaattcaggtgccacatcatcttccactctcgcttttacaatcggatttgccgctgccgcttcatcaccttttgctttcgctctcgcaagcccttccggacttttatccaatgttgcataaatcggctcgtttacctctggttttgccgtatttgctcgatcttctttagattttaaccgagcttttaattcattaaccagttcatttacaaccgcattttccgccggtaatgcacgtttcggcgtttgtggctcggaagacaattccgatggaatcggttcaaattcttcaccgttcgactgaccacgtgccgatctcggctgtattgatggagaggtaatttcagcataatctccctctactgccgaacgttctgtacgcaccgctgtttgcgatggttcgtctaacggaattgtctcataatcactaacttgaccttttgcagatctcggttgtaacacctcagcaattgtcgcataaccatcttcaccctctgccgatgtgcgttttacaggtgctgtttcttgtggtgctgtttcttgtggtagtggaatttcctcataatcgctacttccctgctgacgagatgctctcggttgtaacggcgaaagctcaccaattgtagcgtaatctccaccatctaccgcaactttaggcgtagcctccggtattgccggtaaatcacgttttgctttattcgctctatttacaacatcattaatgtcggcataaatatgatctgccgtatcaacttcctgagttaaacggaaatttggaagttccggcagaggatcattcgcactgcgagttttagaggtaatttccgaataaatttcattacctacttcttccactttgcttaacaagcttctcactgtcggtaattccggcaattgatcactcgcagatcttctcacactgccgtacagcggattatccaccatttcaatgttagaagatgcttttggtttggacaatacgctgtaaatacttccaatcgtatcataaacatgatctgccaaatccgccccctgacttaaacgagttctaaactcatttggaagaggtggtaacggatcattcgcattgcgggttctagaagtaatttccgaataagtgccattacctgcttccgtgtcgctattcaacaagtttctcactgtcggtaattccggcaattgatcactcgcagatcttctcacactgtcgtacagcggattatccaccatttcaaggttagaagatgcctgcggtcgggacaaggtactgtaaatgctctcaatagtatctgctagaactttatttctcgtcccttcaccacctaaaaggctgtaaggactatcactttcaccacctaaggttctatttctaaccgcacttccattacctaaaagactgtaaggaccttcaccgatttgttcgtaaatatgttcctctgcggcttttggttttcctaaaagactataaggacctgctgcaatttcatcataaacatttgatctgatacgagaaatatctgaatttgcatcacctaccgtactgtaagtgctatcactttcaccgcctaaagttctatttctaaccgcacttccattacctaaaagactgtaaggaccttcaccgatttgttcgtaaatatgttcctctgcggcttttggttttcctaaaagactataaggacctgctacaatctcatcataaacatttgatctgatacgagaaatatctgaatttgcatcacctaccgtactgtaagtgctattactttcaccacctaagattctatttctaaccgcacttccattacctaaaagactgtaaggaccttcaccgatttgctcgtaaatatgttcctctgctgcttttgttcttcctaaaagactataaggacctgccgcaatctcatcataaacatttgatctgatacgagaaatatctgaatttgcatcacctactgtgctgtaaagatcatcgctattgttacgtaaggttctacccttgttagcgttgctatcgcctaaaagatcgtaagcaccttcagcactcactttgtcataaactggctcatcgccagatactttcacttttcctaagaggctgtaaatatcatcgctaccgttaggcaattttcttcctttattggcattttgatcgcctaaagtgctgtaaccttcacctacctcatccaaagttcttagtttgcgtacgtcggcattagaaccgtaaagcggattatctaccatttctacaacatcttctgaagaaattctggttgtagtcggctgttcggcatcattatttactgctttgctaaacttagattgtaatttagattttgctttttcacccaactccactaagtctgcaacttcaaaattgaattgtgtacttgcatatacatcatctctcgttacggtcttagctttgcttagatcatcaacaatttcgcccgttacattattatctttaagattgattccggaaataaccgatttttgtaccgcatcgtaatgtttttgctccgcacgcccaccacgtacattaaatgaagatgcaccacgctcgttaatacctacagaaacgccgacagaaccaccatctttatgatgactatcattaagttgttggctcgtaacatttcctgaaacacggaagccactattttcatctttattgatgaaatgagccgctacaagatccaaatctttaatttgtccggtaattctgttcgcaacaatacctgcctgttgattaagaagttttctgttctcaacttcatgagtataacctgccccaaaacttccattcccttttacaagggtagaactggaaagtgcggcaccagccgatgcactaaaatcaatacttctataaagtctatcaaaggaatcttgttttgatacaatattcgttttacctttgatatttaaatctaaatgatccgctttaatatttgaactaatcaaattaagatcttcacctgccgcaatttttagatttttcgctctcagcaagctgttgttatgtgtaacggatttttccgtggtaaaactttcattgccatcaacagaacccgatacgccaccattacagcctccgctcatcacgctacaacctgaatttataccaaatgcaaatttctgacgagattgtctttcagtactttctcttgttgtttcgccatcaagtatatcaacgttacgtttggcttgaagcgttagcttactgttggcatcgctttctacatttttcaactgtagatttccaccatgggctgaaagcgtaatattacctgcaatttttgtgcgtatatcagaggtttccttaaccttatttgtttcgtaattacgctcaaatccaaacttagatgaaccgccaaccaattcgccggtaacaatatttgcaacatcgctaatatgttgcaacgcaactgtaccatcttgcttaacgccacgttgtgcctctacaatttctttcgctacatggctaacagcatctgcaatagctgagtgtccttccgtttcaataccgaatttcaagactgaacgttcagaatcaagatgatattcatctttttgcttattcgatgtaatctcttttgcagaaagttcaaagccttcatcttctttaactttcttatatttgttgaataaatcattggcagatttttctgtcatcaaatcatcaacttcactttgagatagaactttaaatttaggttcctctttctgagctgcgttgtctgttgcatcaggtgcggcttttgccttagcctgttgctcagctttcgcttcatcttcctctaccgcttttcctgtgaacttatgcttgttaatatcaacaccaccgatttccgcttttttcaatacatgtaaaataccatgatcgacctgcaaatcgctgttggtgtgagttaatgatgtttctttttctctcgtttcgctgaaagatccgcccaaagtaaaaccggtgccggtattagatgatgcaccaccaatatttgttttctcgccgttttggctatcacgttcatggcttacagtgaaccctgcaccgctaatatgaccggatgaatattcttgatccaagcgaatgtaacgttccgtctgttgtgcattgcgacctgccttggtgttataatcaccttgtacaactccggtaacaacttttgccttgatcttactgccttcctgattcacatcattttttatagcgaaatgtacgtgatcaaattcggtatttgaaccgacagaaatcgctttttgcgtgctttccttacgatagcccaatatctcgcctttcttagagaaaattctacccttttcaacggaatgctcagttctgtgagtatctgtcgtattaaaattacgagctttcacaaaacctgttttacctttaatatccgatccttttgaattaatatctgaatcttcatctgcttcaaggtgtaaatgtccctctgttctaattgatgcacgttgaacttcaacatcgccgtttccattcacaaaagagcgggcagtattatcaattcctttatgtccaactaagcgagtgctttcctcacttaaaatatcacctctatttttaattttattttcggcttcaatatcaatatttttaccggaaatcgtaccgctgtttagcacatctcttgttttcaaattaatttcattagcacgaataagtgcatcaccaagccctttgaatttttcagcatctcttaatgttttattcgcaaaataaacttgtggtaacagaacctctttattgttgatatttgctttaacataccaaacaatgtcttgtttaagttgattttgttgttcttttgttagtgcttccccaactttcaaacctaactctttagattcaaaataagagttatctattaattttttaaccaactgtgcatcatttacttgatatttcaatgccaaatggttatctactttcttctcaatagattttgtaattaactgatgttctaaatagttatcaccaattaccgctactttcttaccggcatcggtagatgaacctactttatttaagaaatatttagatccaaaatattcatcttggttaatatactgcaatttcgttctgtaaagcggatcggtttccactttaggacgtgtatcatctacctcttttaagaattggtttttcgaaagtgcttcttcaatttgatgatctttcgccagctcttttctgtattcttcaagacgtttttcttcttcaactttcgcttttgcatccgcttgtttttgctcttcttgcttttgtttcgctaaagcctcttgttgtttttcctcttcaattttgccttgtaatttcttctcttccgcaagtttttcggtttcttgctgagcaatttgtttcaattctgcttgtttttcaagtgcacttttctcttggcgtttttcttcctctttataacctgtttctaggtcgctttgtagctgttcatttttggtttttgctcgaagagcttcagcttgacgtttctgctgagattcctttttcaattcttggaatttttggcgtaatttttcttgtaccgtagtaggtaaagtatcaaatcgctcccttgtatctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacttatctaagaattttccattagtttttaattcatctggatttaataaatcaggctcttctcctgtatgaggttttaatagaaattcgtcttcatcttcaatttcaatatttggatcaactgttttatctaactgtacgctgttatccacaaaaagatttggaatagataacaaatctgacaatgcggataaatcaacattgctattattcagattttcttttccattcacttccgatctaaactctactttacttaagtcgaatttatgttgtcctacagtgatttgttcattttcagaaaatcctccggttgaaccattttctaaagcmtycacctctccctgaattcttccggcaagaattttagccttatcatttggacgataatcaaaatgtgcatcttgtttttctttaaatgatttccagcgttctgacaatgccttatgatcactatttcgccaatctgccccaaagacywgcaccatcgctttttggaatgtatccgacttaatctcttttaataagtgcatagcttgcgagttatccgcataataagaactggagcttgttattggttgctcagaaaataatccatcaaaaagatattcaagggaatcaaattttctctctgcattccctgaaagtgcggataaaaagagacgggctcttggctgataattaaatgtaatttcttgtttttgtttgaaaaattcattcaacaaattggcttggtaagccttcatattatttacaactttcgcattttgggcttcgaaagtgtttttaacattaatcacaccatggttagtgagtgttgcctcttgttgactatctcctttcttaccttcgaatttgaaatttccttccgcacggatcaagcctgctttttctactttcacctctgctttttcaaattctattggattaatccataaacgatagtcgttattatgccaaccatgacttgcgatatcagaacggcgataacgggttaatacggaagaatttgttcctttgctgactttgcccgacaattgaacatcattaatcagttcattagcttttacagtaagatcgctcttagcaaaaatattacccaagttgtaaacggtattttctgcatcgagttccattttaccctcagaatgcaatagagaatccgctccattaataatatttccctcagtttctttattatttcctttagcagataaagtcagttgttcacgagcacccaaaatccctttttcattatagatatttcctttttgagcattaatcgtcagcgtttttccgctggctaataatccgttgttaacaacattacctgccgcattaatggtaagttttgcagtagtttgtagttcatcattttcgctaataaccacatttttagcatcaatagtcaactcatctttcgcttttataaaatggttacctttgctgacaaaacttgtaccatctttaaaagttaatttagctttagatttactttcaatggtaccggtattttcaaaaccaacatctaaatcagcaacggtttcttctttaacgtccgccttgcgtttattgtctttatttatagaaacagtaactgtcttacctttggttgtaatatcaagattatcttccgcataaatttcttttttattgactaatttatcggtatcaatttttactgtatgtccgtaaatacgcccttggttagtcaatgtttgagatttaagctcaagatccgttgcaacgacttttgtctcttcatctagcacaagagatttggttacctccacttttacttttttagaggctaacttccctttgttttttaacttggcatcttctgtagttggtgtctctttattattttttaacttaacatcatctgcggttattgtgatagacttatccgccgtaatctcatttgctatagtaattcttttggcgttatttaatgaaatctcatttttggcttgtagtttatcacctaaatcaatatcccctttgttgctttcaattttaatatcgctttcagataaaataataccgtcgtgttttacacccgcaccttgatccgttacgatcaatttaatgcttttaccgtgcatcgcacctgtacttgcaccggtaatggcgacttcttctgtatcggaagtctgactagtactactgtctttttgtacttctaattttgttttgtcatcactctcaatactatatttagtcttacctgtccctgcaataaaggtaatttctgtttccgatgttttgttcttttctttctctttatttttaatcgtacctttctgttcaattttcttcgcaataatatctaagtaaggtaaattatccgttgcaaacccgttgacatctattgttactgttccttgtgtaatgttaaattccatcttactaggatcaataggactgctggtcgttgcaacaaaacgtcctgcgttaatggttttcaccccatttaaggtaattccattttggttggcaataaccaaatcggcttttgtacctaaaatttccaacgcccctttaatttgactaagttctgaacccgttacctgatttaaaataactttcgcttctttgtctgctagattcttattaccttccagataacctactaattcagaacgttgttgatctttattatttttaaacaccgctccgtttggaatattaaatttttggaaacggttatctgaaattcctttatcattcggtttcgcaatatcgataacaatgacgttattttctgttttgtatagtttagtaggatggttattttcagttgtacctgcacctactcctatattttgattcttagtctctaactggataccgtcattaccattttgaatatcagttagctgaggttttttctccgtttttgtcgcttcctctgccgactgtgcaaaattcggtgctgctaccatacttaacagcaatacagaaacgcttttccaatttaagcacaacgcggaagataccggatttaaaaaggtttttacggataaacatacgttggataagcggtagtcttcaatggatccctgccggtcttcctcgtctgttttttctgacacaacaacagaatcagatgaaccactatctacagctgatgtaatacattctgctacaggaactaaacaacctcttgtcttgctgaaaataagcttataacaattcttattcataataccttcctctaaactaaaaaatcaaaacgaaaccgaacctgtgaaataaaaaaccgacttcttgttactttcctcaaaagttcccactccattaataggcttagcataagtcaatgataatgcaagtgattttatttgagctttcacaccgaatgcaaaccccgcaaacgtatctacaacatggtgcggtcgttttgcatgaacttttcctatatcaatacccaaaaaagggttaatgtaagataaataactcttttgagggtaaaaagggatcgtaactgtttgagaaatatagaatccacgatcacctgagcctgccccacctttgaatcctcttaccgtatattcatctccaattgagaactggttctctccatataagctatcaaatccatattgtgcacctaaacgaaattgataactcattcctcgattaaaaaaaacaaacggtctctgccagttaatactgcctgaaaccaatcttaatgttttgtctctatgtgaattatgtgcagaatgatttgcattaaaccaccgcagtccattggaataagagagatcagtgtaaagtttaccatgccccaaattagccacataagataatcctacattcaatttgttattgtgatattttccaatgcgaatatcaccaaagtaactaagacgtcttttaaactcaagttctccatataaagataaaatcacatctttattacgcaataatgtgtgcgataacttaaatgacgcttgctttgtttccccactggatccgtgagtatgaattcctctcaactgtttcttataaccggaatatgataacttaatatccaaagtcgaaaatgagaaaggttgagtataagacaaggaataattttgttgccgatttgcttgacgatccttataaatacgataacccgttgaaaaactccaacggtcattcgttcctaacagatcactccatgagatgcttaatgttgcctgatttcgaccttcggcattacttccttcaccggaattattcaggcttaaactaacctgcggataagaagtgcggtgcctctcaatgctcaaatttgacatacttttctcattcgctgcaatcacattcacctttgctgtcttatttcccgtatttagaatttcgatcagctgatccacgtcgtaaatacgaagtacctttccttttaaattaggcaaaacaaatagcattgctttatctttgaacaaagaagcctgctgttcttccactaaaatatcattcacttttccccaaagtacgataaattccacttcaccgtttttgatctttgaagattttaaaccaatagcactggttacataaccggcattgtacaatacttgtgttagctcttttgtcaacgcaaacaccgtttttgccgataatggttggtttaaataatgttttgttacttcatcaaaatccaaaaagatctcttccccaccaaaatcaatggtgatcttcgtgatcttttgtacatcttttgctgattttaattgctcaactatctgttcttgatttggtcgattatcttccaaaaaccgctgtgctttctcgaaattttgctcaactttttcaaattgttgttgattttttaaacgtgataactcttgaaccaaaggcttagcctctttcgctgcttctcttgcttgcgtaaccaaaggatcttcttgtgcttgcacaactaaaggtgcaacaacaaaagaaactagtaaacagcatgaaaataggatatttatcttgttatatttatattttggcataaaacgccgtccttccactttaattgggacaaattataccatacgctatttagacaactggtaataccagtataaatcattcttagcaatttcatcgtgtctttttcataatttttcataaaaaaatacccctttcctgtgctaaaaagaaaattgattatactatagtttttatactattgaatggaatgaattacgcagtaattactttcttatttttatcttcgttttatcataactgtcattttcattaaataatactaatttcctctttaaatctctccttttttcgagtagattaagagttctcctcaaaaaattaagtaaccataaggaagaacattatgttattaactaacccagtagtaatttccattattgtgttactcgccttaagtcttatgcgaattaatgttgtcatgggattagttatctcagcattagttgccgggctatgtagcgatttaaccattaatgaaacaataaaagcgttcacaggcggtttaggcgggggggctgaagttgcaatgaactatgcaattttaggtgcttttgctattgccatctctaaatcaggtattaccgatctacttgcttttaaagtaattaaacgcttaggtaagtcgccaacaggtaattcaatggctggatttaagtactttattcttgccatactagcgttattctcaatttcttcgcaaaacttattaccagtacacatcgcattcattccaattgttattcctccactcctttcaatttttaataaactaaaagttgatcgtcgtgcggttgcttgcgtattgacatttggattgactgcaacctacatgcttctccctgtcggtttcggtaaaatttttattgatagtgttttagtaaaaaatattaatcaagtaggtgcttcactcggcttaaaaaccagtgtagcagaagtctctttggcaatggcaattccggttatcggtatggttatcggtttattaaccgcagttttcgtcacttatcgtaaacctcgagagtatgtttcagctggtttaaatgctacaactgaagaaatcgaaaagcacattgcaaatattaagcctttccatgtgattgtaagtgcggtcgcaattgtactcactttcgctttacaactgataaccagttcaacaattatcgctggtcttgtcggtctcattattttcgcagtatttggtatttttaaactaaaagaaagcaatgatattttccaacaaggcttaaaattaatggcaatgatcggtttcgtaatgattgccgcttcgggctttgctgcggtaattaatgcaactggcggtgtaacaattttggtggataatttcagccaaggcttgggtgcagaaaataaaggtttagctgcatttcttatgttgcttgtaggtctatttattaccatgggaatcggttcatccttttcaactgtaccaattattacatctatttatgtgccgctttgtctttcctttggattctcaccgttggcaactgttgcaattatcggtgtttctgccgcactgggcgatgctggctcacctgcctcagactcaactttaggtccgacatccggcttaaatatggacggtaaacatgatcatatttgggattctgttgtaccaacattcatccactacaatattccgctcattctttttggttggattgcggcaatgttcctttaataacttactttgagtgcctatggcatggcactcaaattttttaacttatgcaacaatctcctgttattatcttacttaaacaaaaagttgacgagtttttctctcgttattctcatataccttccaagcaaaaaatctatgccaaatttgaccgcactttatttagccaagactttgagagtttgtcgttttacctgaaagaaattcgtcaatgtttaactcaattagaaaaaatcaatgatgataatgtacaaaaatatactttttatagtgaaaaattaaaaggacaatgtaatgctctctcagaggcgttatcacaaacgaatgctaaaacaaacatcaaatttcagcataacgatacaagtctgcaatctgtacaagagcggcgggaaaaacaaagaattgcactgaataaacttcctccaagggagcgtttaagcaaatattatgaagcattacagactttaaacacaaaattagaacgacaacgagattgctttgaagaggctacattattacaggataagcaaacctatagccaacaaatcgcaattacacaacaacgtaaacaacggtgttctgaggctattgaacaactggaagaatatttggctttattagatacaacctcagagaaataacgaaaatataacgaacatatttcacaagtatgcactatttttgtttaaattcttgcattaatcgcttgatctgccgatcattctttttaaatgctcgacaataaggacaaaataataaatgaatattaattgcacatttttgatagaacgctaattttttttcattactcaaagaaatcaattcagtaatttctttacaatttttcatctattttttccctccaaaccaatttttagataaacatgcctgtaactgaagtctagctcgatacaacaatacatgtaaattagacgtagaaatctcacattcctgacaaatttgttcgctatccaattccaaatactctcgcatcataaaaatgcgagcttgctgagctggtaaccgatttaaacaagcatcaaaaataacccaaaactcctctttataagtagcactttgaatatctgaccattcattaggttcaaaatggtttaaatcccaatgtcctttatcgttaaaaaacgcatttggtgcatcttcttcacagatttcagaaatattaatcattcgattacgactatgaattaagtcaataattttattttttaaaatggcaaatatccaagtttttaatgcagatttcccctcaaaagtgcggatattttttaaagcatttgttaatgcctcttgtaccacatcttcagctagatcaagatccttcagttgcaaaactgcaaatttgaccatttgtaagcgaacttcttcaagatccagttgagaaatatgttttgtttcactcacaatcattctccttgacaaaataatgtaagatttttcatcattctctgactatacaaattatacgctaataatataggatttaagaatgaaaaaattaacttctcacgatgttacacctgaagaaattttctaccaacgtcgtaaaattattaaagccttcggattaagtgcggtggcaactgcattaccaacgtttagttttgcacaagaaagtagcgacttgaaagcacttgaatataaaaaatcaacagaatctactttaattttaacccccgaaaataaagtaaccggctacaacaatttctatgaattcggtgtagataaaggttctcctgcacactatgccaaaaaatttcaagtaaacccgtggaaactggaaattgaaggagaagtcgaaaatccttttacgctcaactatgatcagcttttcactcaatttcccttagaagaacgtatttatcgtttccgctgcgtggaggcttgggcgatggttgtgccttggattggttttgaactcaataaattattagaaaaagcaaaaccgacaagtaaagcgaaatatgtggtatttcatactttgtatgatcccgagcaaatgccggggcaaaaaaatcatttctttgggggcggtattaattatccttatattgaggcacttaccctcgccgaagcaatgcactctctcacgttaatgtcggtaggtttgtacggaaaagcattaccaccgcaaaatggagcaccaattcgcttagttgtaccttggaaatatggctttaaaagtattaaatctattgtcaaaattactctatcggaaacacgcccacgcactacttgggaaagccttgcaccgaatgaatatggcttttatgccaatgtaaaccctaaagtagatcaccctcgttggtctcaagcctctgaacgggttattggtgccggcggattattaagtgtaaaacgccagcctacacttatgtttaatggctatgaacaggaagtggcacatttatacaagggattggatttaaggagcaattactaatgttggcattattacgcatcattattcacttgtgctgtttcgccccattggtgtggttacttttcgtgcttttctcaggaaatgaaaccgcacttggttcagatcctatcaaagaaattgagcatttcttgggctatacagctattttgattttctgtgctatgtttttactcagtatcctattgcaactattgaataaaaaccaataccagattttacgtcgtcctcttggtttatgggcatttgtattggcattattgcacgttgccagctatcttttcttggaattaggatttgatttctcattattcataaatgaaattataactcgtccttatctgattttaggcggcattgcttttctcattttgtcagtaatggcaataacatcgttgccccaaataaagcaatggcttggtaaacgttggtttcaaatacaccagcttgcctatatagcaattatctgtgcagcaatccattattattggtcatcaaaaagtgtaactttagcaccgattgtggtaagcctagcagtgattgggatcgttatttggaaatatagtggaaaatatctcttaacatttttgcataaaaaatagacattttattgtataaaactctcctgattttcaccgcacttttccgctaattgaatgatcatttcacacaaaaagcgacaactaagtgtcgctttctacctttaagcaaaccatcctgcttgataggcaataaataataatgtgaatgcagttaaatacactaaaccgattatagaaagccaaaataacccgcctcttatccgatgttcgccctttaatacaagcgaaagatttaaccacgcaaaaataggcgttgaaacaaaagaagcaatcatggcaaattctaacattggaccgacagcattattgaagtagaaaataatcgctaatccggaaagtgcggcaaataatatcgctaaatttaaggttcttaaactactttgttttttatttaaaattaaacgtaaacattccacatttgagcgagaatatccatcaattaccgtaattgttgtaccaaacatacacataaaagcaataaatgcaataagtgcctttgcccattcaccaatagttgaagcatacatattaatcaattgtgcaatatattttccaccaaccatttgaaccgtttcacctgaaccaaattggactagtgcacccagtgcaagaaatacaatggctaaaattgcagtaccaatataaccgacattaaaatcccaaatgccgtcctcataagatatttttgaaatacggcgtttagcgactacccacattgaattgattgcagaaatttcaattggtgcaggcatccagcccatcaatgcaacaataaaagcaagtgcacttagactccatggatttggggcaatataatcttgcgaagcaacgccattaataccattacgcattaatgcaataattacagcagttaatgttgtcaatgttaatgcaatcataatgagtttagataaactatctagcaaacgatattgcccaaataacaaaataaataagctaacgccaataacaatcagactcaatgtaggaaccggaacagaaatcggtaatacaaaagttaaaatcgcagcacaaagcaagcctactgcggcagtattaataaccgttgaaaaaacatttaataggaaaaatacccatagataagatttccctttttggcgataaccttcaagtaacgtattaccgctatctaaagtatattgcacaccaaaacgaaaaaatggatatttaaataaattcgctaaaagaataataatggctaattgccaaccataaatagcacctgcctgtgtcgacgcaataatatgcgaaccgccaacagccgctgaagccattaaaataccaggacccagtgcacttaatttttttgcccaaaaagattgatttacttgttgattttctttcataaaaattcctactaaccatctaacgaattaaaattctaaaatatttaaatataaaaacaagagaaaaataaaaaataaaattctaataaagaagatttataaacaaaaaataattatataaatccaaaatatttaactttactagattttaatgctattttttaaaaaataaaaagaaataaactctagaaattaagaagttagcaaacaaataaaaaacatataaaaagtaaaagcaaagaacacaatttctgtaacaagatgaaaaaccgaaaaataagatggctggggtactaggattcgaacctaggaatgccgagatcaaaacccggtgccttaccgcttggcgataccccaatagatattctaaatctgaattaactaagaagtgcttaagatagtatggctggggtactaggattcgaacctaggaatgccgagatcaaaacccggtgccttaccgcttggcgataccccaccaactaaagatttgcaagctaatgaatggtgcgggacgagggacttgaacccacacacctcgcggcgccagaacctaaatctggtgcgtctaccaatttcgccagtcccgcaaacatggtggctatgacgggattcgaacctgtgaccccaacattatgagtgttgtgctctaaccaactgagctacatagccatattatttgcattaccctcatcggctttgcggggctaattatgctgatatataccttactcgtcaactattttttaatgttttttttgatttcagtgttgttcgcatatagattatacaattcagataaaaagcatcttatgttgtttttaataaccgtttatgattgatgtcgaataatccaacaattatgaatttgtttattccgttcaaaatctaaaggtaaagttttagcagaaatttctaccgcacttaactctaattcttgcaaaccgtctatatccattttaaaacctcgtttattattggaaaaaacgatagttccatttgttcgtaggatacgctttagatttgccattaacttaatatgatcacgttgaacatcccagctatcttccattcttttagaattagaaaatgtgggaggatcaacaaaaatcaaatcgaattgacgatcacatttattcaaccactgcaaacaatctgcttgaattagtttatgctgcttaccttcaatatcatttagcaacaaattctgttctgcccaatttaaataagtatttgacatatctaccgttgttgttgactttgcttgccctaaagcggcatgaaccgttgccgctcctgtataagcaaataagttgagaaaatccttccctgcagccatttctcctaacatcttacgtgtcaaacgatgatctaaaaataaacctgtatctaaataatcagttaaatttacccataattttgtgccatattcatgcacataaaaatactctcccttattagcaagtttttcatattggctagtacctttttgtttttgacgtacttttaaaattaatttattcgtttcaatacctgttaccgataaaatagcacttacagcatccaataaacgctgacgagctttattttcatcaacatttttaggtgccgcatattcttgtactataatatgatccgcatagcgatcaaccgccaaattgtattcaggtaaatcggcatcatataaacgataagcatccagtttttgttgattaacccatttatcaattttcttgatatttttacgtaaacgattagcgaaatcttgtgcaacttgtgtattttccgatacaaaagtcaatgttttttcttgcgaattttcaaccgcactttctacctgtttacgaacagcaatatggtaatttttttggacacaatctaaaggaccgttttttgccttaaattgacgatacgcacgtaaacgtaaacaatccagcaatgcgggttctccactaaaaattgaaacgttccaatctgcaaactctgtttttaattgacgaccgaatacagaatataaagcaattaaagccggagtagtgcctaatctttcaccataaggcggattacaaatcactgttcctatttcttgttcagttggatttttcaatcctgcaacatcaccttgttgccatttaatgagatgtgagacccctgcattttgagcatttttctgtgctttcttcaatactcgatgatccaaatccaagccccaaaagtgcggtgttaattttcgattaaatgcctgctctgcaagctcaactgcctcttgctttactttttcccacacaacttgattatgacctttccaaaaatcaaatccccaatgtaaacgatgtaattgtggtgctatctgagcttccatttgtgctgcttcaatcaataaagtgccggaaccgcacataggatcaacaagaggtgtccctttttcccaaccggaacgtaaaacaattgcagcagctaatgtttctcttaacggtgctttccctgtatcttcacgataacctcgcagatgcaacgcctctccgctcaaatcgagagatacaactaactcatcttgatttaaataggcatgaatacgaatatcgggatactctttatccacatttggacgtgtttttccatgacgctcaaaataatctacaataccgtctttaacacgcattgcaccgaactgagtatggcgaatttctctattagtaccgttaaaatctaccaaaaaagtgactcgttcatcaaaatgagtcaaccaattttgtccaacaatagcagaatataaatctaaatcactataaatttttgttgtaataagcggtaacaaaatccgagaactcaatcttgaccataataaaatgcgatactgcgtttcatcattcgcaataaagtgaactccaccttgtacaactcgacattcttgagcaccaagatccgttaattcaacttttaaaagttcttcaaaaccacgtgacgtagtagcaaaaagttgtttcattctatctctctataaagtaaaaattgggcgaaagcccaattaacattaatgattaaattgcgtgctatgtagctgtttataagcaccatttaaggctaataactcttgatgagaacctcgctctttgatttcaccctgctcaatcactaatatttcatctgctttctcaatagttgataagcggtgtgcaataaccaataccgttctatctttctgcaaagtttccaaagcggcttggattgcacgttccgactctgtatctaaagcagaagttgcttcatctaaaatcaaaaccggcgaatctcgtaataaggctcgagcaatagccaaacgctgacgctgtccgcctgataaactcgcaccgttctcaccaatcactgtatccaaaccattttctaatttttcgataaactccatagcataagccgcttcagccgcttcaataatttgctcacgagtacatttctctgtaactgcataagcaatattgttagcaatagtatcgttaaacaaatgaacttgctgtgaaacaaccgcacaatgttcacgtaaatttgccaaagtataatcttggatattcaccccgtctaaagtaattttaccttgttcaacatcataaaaacgagtaaccaagttggctatagtcgatttacctgaaccagatcgtcccactaatgcaacggttttaccttgcggaatagtgaaagaaatattattcaatgccggatgttcttttccactgtaactgaaagtaacattttcaaaccgcacttcccctttaactgtatctacaacatgtttccctgtatccttttcagtttcgagatctaataatgcaaataaagtctgacaagccgccattccacgctgaaattgtgcatttacgttagttaaagattttagtggtcgcatcatagcaagcattgatgaaaaaacgacagtaaatgaacccgcactgagattttgtgtcatgatttccggtagcgttgccaaaaataaaacggcagcaagtgcaaatgaggctattatttgtacaaccggatcggaaattgcactagctaccataactttcatgcctctacgacgcatattattacttacttgatcaaaacgctcttcttcaattttttgtccgccaaaagctaaaacaactttatggccttttaacatttgttctactgaagaggttaaatctcccatggagttttgtaaattttttcccaattcacgaaatttttttgacactatacgaatgataatcgcgataattggaccaataataaaaagcaccaaagccaattgccagctggtataaaacattaccgtgagtaaagctataatgtaagccccctcacgtacaattgtaactagcgaacctgatgaagaatttgctacttgttcactatcataaacaatacgtgacagtaacctccctaccgaattctgatcaaaaaaagtaacgggcatatacattaaatgcctaaacaatctacgacgcatcaccatcacaactttgcccgaaacccaagctagacaataagttgaaatgaaattggtgaccccacgaacaaatattaacaaaaccaccacaatagccattattctcaagagcgaattgtcaactttaccaaaaccttcatccaacaccggttttaacatttggatgagtgccgcatcagctaaagcattaaataccaatgctgcagcagaagcaattaagcctaatttaaaaggtgctattgttggccatagccgtttaaatgtttgtaatgtagaaagatctttatcttgcatattcatacttctatcgtaaaaaaattgagtggcattatacatttatttaaattacaagccaattaatcctctataccaagggctaaactctgtccttgcggtttgaatttgaatatcttttcctttgaatattaaacgaatttgaccggaaatggccgtattatagaccgcactttcaaccgcatttaagcgtttgacgacatcttgatgcggaaatccccaaggattccaacgtccactggaaattaaagcaattttaggctgaatatgctgtagtaatttctcaccggttgacgttttactaccatgatgtccgacctgtaacacatcaatcttacccaagtcagacaaaattttatattcagtcgccacatcagcatctcccgttaatagtactttatgctgtccatctgaaattatcagcacacaagaatccggattattggctctcatcacaattttacttggcgataaggcttcaatatataacccttgccaatgccatatttttcctttttgacaagtaatatgaggtctattttctggagaattctcgtacttttttaatgagggactgataaactcagcattcggataagcttggaaaatatcttttactccacctgcatgatcattatcatcatgacttaatataactttatcaagaataataccctgtcttcttagataaggaataatctcaatttttgccatactaccatttttccagcttgctcccgtatcatacaaaattccatgttgattttttaccaataaacttgccaatccttgaccaacatctagagtatcaaattgccattgtgtgttttttaatcgcccttgttcatatagcgaaaaaaaccacagacataaaaaaataacaaacatagctgaactgaccaccataccatattgatattttttatgtgaaaaaccgtccgaaaaattcaaccgtatagggtaaaaacttttttttctaacttttctcaataaagataaatcatcgtcggttgaacacttaataatccatttacagcataaggtgaagagcaaagctaatatagctgaaataaaatagctttctgcaagagaaatattgatccactgatttggtaacagctttaacaattgattgatccatatagcaagctgatcagctatattccagctatttaacgcaccttccgtcagtacagcaaaaagaataagtggaactaacaaaaaactgaacaaaggcaacaataataaattagcccaaaatccatttaaggcgataccgttaaaaattaagagttggataggtgtaaaaaaccacaaaagcccaaattgcaaatgaaaaagaccgataaaataccgcacttttttcaaggaagattgtgccaaaggcttttctttccataaaaataaatttagcggtatccattgataccacatgatcaaacagcctaccgctccgattgatagccaaaaactggctgacaataacataaatggattaagtatcagtaaaacacaaataacccgcaaaaatagttgccaaacattataggaaactcgacatatgcgacacaaacaaactataaataaagcgacaatcgcacgaaaagtaggaattgaaaatcccgctaattctgcataacagaatgctaaaaaaagccctaatattaaaggaaaataaggttcaatataacgagtagggaataataattgaatagctcgccctaatgtaaaaccgatgaacatagctaaaccaatatgcaaccctgaaattgcaattaaatgtgcggtattggtttgttgataaagttgccataattccttgtctaaccatgctctttcaccaaaacccaatgcaagcaataaaccttgtgaaactaaataggaagtttgttgtaaagcttgattcagtcgagtagctcgccaagaaaaatcctcaccaattttcaccgcactttttactgtggcataagctgtaatttcttttgctaaataccaggtttgacgatcaaatcctcctatatttaatcgagaagaaatcggacgaatgtgcatatttacttgccaaatttcaccaacttgaacctcttgctcagtacgccaatttaaataaattcgctgtgttggcaaagatgaggtgaattttccttctgcgatcactgcttgatagtctttctgctgaataatttcggctattttaacgttagtttgtacttttttaggtaagcgggtaatatgctcactttgttccaacaagtttaatgcttgataatgaaaaaatcccaacccaagaacaaaaatgaaaaatagctttagaacacagcgaaaaaatactgctttaacaccaatatatcctaacccaagaacaagacataagatcaatatccattgccaattcaataaaaaaatacgaggcgtaattagcaatgtcattgcactcactaaaataacaaaaaggtaatgatcaaggttgaatttcattgataaattgaagattaattaattcttaatctacaatatgaaaaaaatacctataaaaaccaagtcagataaacttatcttggaatacaaatcacaaaatcaacaaaataatagaaaaaaatgaagagttaacataaatttatttgcttatttgagcaacttctgatatttatagcgcctttaaaatcagctgttccattttttggagtttttgaacaatcataaccagtttgcaaagtgctttcttaagttacaatcaattgtaagccacagaatgaataattattaggagatttaaatgtctaagtcatctttaagtttattagtgctcgccggcgttgacccttataaagaaaaaaaaggcgaagaatatatgaacgatgagcaacgttctcatttcagaaaaattttgcaggcttggcaaacacaaattcaggaagagacatctcgtactgtagcacatatgcaagatgaagcttcgaactttccggatcctgctgatcgtgcaacacaggaagaagaatttagtttggagttacgtgcgagagatcgtgaacgtaaattaatgaaaaaaattgaacatacattgaaaaaattagaaacagacgatttcggttattgtgattcctgtggtgtagaaatcggtattcgtcgcttagaagctcgcccgacagcagatctttgtattgattgtaaaacgttagctgaaattcgtgaaaaacaaatgatcggttaaccaattgatcaaatttggataatgtaaaaataaattttggaaacgttttttgatagttggtttgttagcttaaaagaaattttagaacataaatcaattgttagtgttaatacgaataaagtgcggtcttctctgccgcacttttgaatttttataaaaccacaagatattaaaaaaggggtttattattttaaaatttattcaaaatctgttaagaaaaaaaaataaagtagctaaattaccaagctcaaatttgcctctaacagtttctacttcaaaacataaaactatctctcaggaaatgcgaactgagtcgctttttattgcaacaaaacagcgattgatacacaaaaatcaacacaataaatatgttgtcaaggcgtctcaatacggaattatgccacgtatgatcagtcgtaatgcactgtcagttgtagaaaaattacatcgtaatggttatgaagcttatattgttggcggttgtttaagagatttattattaggcaaaaagccaaaagattttgatgttgcaactaatgctaaacctgagcaagttcaagctatctttcaacgacaatgtcgtttagtggggcgtcgtttccgtttagctcatattatgtttggacgtgatattattgaagtggcaacattccgtgcagcacactcggacaatcataatgaacgccaagcaaaacaaaataatgccggtatgctattacgtgacaatgtttatggaactattgaacaagatgccgaacgccgtgattttaccgtcaatgccctttactataatccgcaaaataatacattacgtgattatttcaacggcattgaagacctcaaagccggaaagttacgtttaattggcgatccagttaaacgctaccaagaagatcctgtacgcatgcttcgttctattcgctttatggcaaaactggatatgtttttggataagcctagccaagaacctatcaaaaaaatggctcatttattaaaaaatattcctccggcaagactttttgacgaaagtgtaaaacttttacaagcgggttatggtataaaaacttatcagttgttacgtgaatacggattatttgatcaattatttcccacgcttacaccttatttcaccgataaagcagatagctttgcagaaaaaatgattattaccgctcttacctctacagatgaaagagttgccgataacttaccaattaatcctgccttcttgtttgccgctttcttctggtatccgctaagagagaaagttgaaatactcaaaaatgaaggtagtttcaataatcatgatgcttatgctctagcaagtaatgatattttagatgctttttgtaccgcacttgccgcaccacgtcgtcatacaactgtcatccgagatatttggtttctacagcttcaactgcttaaacgcaccggttctgctccgatgcgagttatggaacatgccaaatttagggcggcatttgatctcctcgttatgcgtgcacaaatagaggggggtgaggcaattgaattggcaacttggtggcatgaatatcaacttagtaaccaagatcaacgtgaaagtttaataaaagaacaacaacgccttaatccgaaaccgaagaagaaattttatcgttcaaaaaaacatcggaaatctacgctatcatcatgaagactgtttatatcgctttaggaagtaaccttgatacgcctatacaacaactaaatctggcactaggttcattagctcaactcaaaagttgtaaattaagtgcggtaagttctttttatcaaagtaaacctcttggtccacaagatcaaccggattacgtgaatgcggttgcttgtttaaaaaccgaattagatcccatagccctattggatcaattacaacatatagaaaaccaacaaggacgagtgcggttacgtcgttggggtgaacgtactttagatttagatattttgttatatggcaatgaaattatccaaaatgaacgcttaacaattcctcattacgatatgaaaaatcgtgaatttgttatcattcctctttatgaaattgcaccacatctcattttacctcatggcgaaaaattagcggatataatgctcaatttcactcatcatcaaatgcaaaaattataaaatttaaggcaaatatcataatatttgccttatttgctgaactaattttcaacttaaacattattgaattttttttcgaaggatttgacgtcgttgactataaattacaataagttttccactcaccattcactgcggtaccaaccacattaaattgattatcaaagacagttaagtttgcaatcttgcccacttcaatcgaacctaatctatcatcaacgccgattgcacgagccggatataaattacacatacgtaaagtttcatctagaggaacttcaacatatttcaccatattttctaccgactctatcatagtgaccgccgcaccgcctaatgtaccattagcgtcatagcattttccatctcgcacatagattgtttttccaacaaattgaaaagattcaatattggctccggcggcggctgtcgcatcagtcacaatacaaagtttatcgcctttcaactttttatccagtttgatattttcaaaactcacatgtaaaccatcggcaataataccgctataaatatcactatctaatactgcaccaacgacacccattgcacgtccggaactaattggcgacatagcattatgtaaatgtgttgcaaaacctgctcctagttgaatagccttttttgcaacttcatagcttgcattgctgtgtcctaaagaaaccaagatcccattttttacaaactcaggaatatgttttgcggttggattttctgctgctaaagtaattttggtaatgacatccgcattatcacataagaaagatttcatctcgggcgtaatttctcgaatatattcatcacgatgcacacctttacgctcaacacttagataaggtccttctaaatgcaaacccaatgcttgattttgatatttttccaaataatctcgcatgacttgcaccgcacttttcatcccttcatcaggtgaagtgataaaagtcggaagatagcttgtcgtaccggagcgtaagttcgtttcttgcataatctctaatgtgcgaacactaatatcttcattaaacattacgcccccacagccatttaactgcaaatcaataaaaccagcggttaaattattaccttttaaatcaatacgttgaatttcattacatagctgtttttcggaaacaatggctgaaattttatcgttttcaaccactactgcatgtccgtacagcacttcttttgccgtatagatcacacaatttataaaggcatatttcattttttcgtccttttaatcaagcacgctatgaatagcacgttgttccagttcagtaaaatacttaaccgtttttacttttaattcttgtgttgccggttcatcacaaacaaaaatagcatgacgatgtaattgcaatgcactaattgtccaaaaatgattaacatttccttcaacaccagcttgtaaagccaaggctttattatgtcctgttaccaacaacataacttcttccgcatctaataaagttgcaactccaatagtaagtgcatatttaggcactttagttacatcattatcaaaaaaacgagaattggcaattaatgtatcttctgttaatgttttaattcgagtacgagaggcaagagaagatgccggctcattaaaggcaatatgcccatcaacccctacaccgcccataaataagttaatcttaccgtaagatttaattttctcttcataacggcgacattcttcatcatgatcatctgtattcccatctaaaatattaatattttgtggctgaatatcgatatgattaaagaaattattatacataaaagaatgataactttcaggatgttctttaggtagacctacatactcatccatattaaaagttacaacatatttaaaactcacttcctccgcttgatacagtttaattaactctttatatgtctgtaatggcgttcctcccgttggtaaacctagtacaaacggacgttctgcagtaggagcgaatgtattaatacggtcaacaatatattttgcagcccatttactgacttgttgtgctgtttttaatggaattaaacgcataaaatcaccttaattatttcaatattgtcatgtacaaaatgaagttttatttcagaaatagaataataaataaaattatacactaaatctaataataattagcctatttcttaaaatagtgatctcaatcacagataaataaccgctacatttggattgttccacattgtgaaacatattattgagcaacattaatggtgtcggtataaaggataatatgaaccttttgatttaccatttttccaacgcttgttgatcggattctcgatgttcaatccaacgtgtaccttggcaagtttgttcctttttccaaaaaggggctttgctttttaaataatccataatgaattcattagcctgataagcatcacctcgatgagctgtgctgacacccactaagacaatttcatcacccgtatttaacaaaccgacacgatgcaccacagcaactcgataaagttgccaacgtttttttgcctcgacaacaatttcctgcaaggctttccctgtcattgccggataatgttccaaatataaaccggaaaccgaatcgcccaaattcatctctcttactttaccgataaaaataaccgcagcacctacgctatgaggctcggttagccattgataaatcgcattttgatcaaaattttgctcttgaacggaaattttaatatctggcatttatcctcccgtaacaggtgggaaaaatgcaatttcatctccggaacgaaccgcactttccaacggtttaagcgtttgattaatcgcaaccaatagcttccctttctctaaagctaatgcccatttatcacctttttggctgagatgttgacgtaactgctctgctgttgcaaattccgctttaacctctaattcatcaacaccgattaattctctcgtttgtgcaaaaaataatacttttaacatctttataaattcacttcttgtctattcagcaataaaatgccctgattttccaccgctcttttcaagtaatctaacctgttcaataacaatgtctttttgtactgctttgcacatatcataaatggtcaatgcagcaatactggcggctgttaatgcttccatttcaacgccggtttttccacttaatttacatatactttcaacacgaacactacttatttcaggaagtgcggtcaaatttacttcaacttttgataataacaatggatggcacaacggaataagttcccaagtacgttttgccgcctgaatgccggcaatacgtgcggtagcaaaaacatcacctttgtgatgttgccctgacaggatcatttccaatgttgccggcgacattcgaacaaacgcttctgctcttgcttcacgaacagtatcctgtttagcagaaacatctaccatgttcgcttcaccttgatgattgatatgtgtaaatgttgtcatatttttcttttagcccccaatacttgcgagatgatttcgtacaccgctatcgccgatatgtaaaaaatgatgttctcttttactttgtaaagccgtaaaaattcgactttttaattggttctgctgctcatcaaattgcaataaatctcgtagatcaattccttcttcaccaaataaacacaagtgtaattttccctttgccgaaactcttagacggttacaacttgtgcaaaaatttttttcataaggcatgatcaatccaatttcgcccttataatcaggatgtgcaaatacctttgccggtccatctgcacgttcttttttctgtatgctccacccttctcttataagtttttccgctaaaatttgacctgataaatggtattgatgaaaaaattgagccatttcgccggtttgcatcaattcaataaatcgcatttgaataggacgctctttgacccacattaaaaattgatcaaactccttatcattgagagatttcattaacactgaattcactttaattttttcataaccaatttcaaaagcacggtcaattcctcgcataatatcgtgaaatttatcaacgccggtaatcgcatgaaacattttaggatcaaggctatccacgctcacattgattgcactgattcccgcttttttccaatcctcaacttgtctagccattttgtagccattagtcgtcaatgcaatattttttattgtttcaatagcacgaatattttcaacaatggacaggaaatctttacgaagagtcggctcaccaccggtaatacgaactttttctgtacctaattgtgcaaaggcattcaccaatcgtttaatttcaaccagattcagaaaactgggttttgtgctttccgctcgatagccatgaggtaaacaatagttacaacgaaaattacacatatccgtgacagataagcgtaaataatagtatttacgttgaaacgcatcaataagatgattttcaataacattatgaatagaaatagatctttgcactagacacctttttaaataagaaaggataagtcgtttccaatattatccctgagcaattatatttgctggcattgtttccttatttttcaacttaggtaaacaagctcggagttatgcgataacgctcgtattttaaagaaatttaactcattagcctagtcttaaatgaatgaaattaaaaaattgtaatttagtacataaatttaagtgataaacattcaccttaagcatttcaatctttataataggtgaaattttatggagagatattatggcaacaattaaagatgtggcaaaaatggctggagtatccacaacaacggtctcccatgtcatcaataaaacacgttttgttgcaaaagaaactgaacaacaagttttgcaagcaataaaaaacctcaactactcaccaagtgcggttgctaggagtttaaaagtcaatacaacaaaatctataggaatgattgttacaacttgtgaaactccctattttgcagaaattattcattccgtggaagagctttgttatcgacaaggttattctctatttctatgcaacacgcaaaataatccggagaaaatcaaaaaccatctcgacatgctggctaaaaaacgtgttgacggcttactcgttatgtgtgctgaatatactcaaaactctcttaatctccttgccgcattcgaagatttgccgatggttgtcatggattggggaccatttaatgaaaatacggatcttatccaagataacagtttctccggtggatatattgcgaccaaatatctgattgataatggtcataaagatattgcgattatttccggagaattaaaaaaaactaccgcagtaatgcgttatcagggatttgaaaaagcaatgcaagaagcaaatctggctatcaatcctgactggatcatggagggcttctttgaaccggaagatggctatgaatgtatgaataaaattcttgtgcaagataaactgccgactgcggtcttttgttgtaacgatgttatggcattgggtgcaatttcagcaattggagaaaaaggtttgaaagtgcctgatgatatttcagttattggttatgataatattcatgcctcacgcttcttttctccccctttaacaacgatacatcaatcaaaatcccgtttaggtgtacaggcaattaacctattgtttaaacggattagtgaaaaggggaaagaacatgaaattatagaaatttatcctgagcttgttattcgcaaatcagtgaaaacgctataaannnnnnnnnnnnnnnnnnnnnnnnnnnnnnnnnnnnnnnnnnnnnnnntttacctattatctaattgaatatgttcaaacaattttttcaccgcattattatctcttaaacgttcagcttgctcgaccaatgttcgagttaagtgcggtgagaaatattgaataaaatcgtacatataatttcttaaaaaaataccatgtttaaacgctatttgtgtcatactcgatctaaataaatggcttgcatcaagtgcaactaaatcattgtcagcctcagtgtgtgccattgatgccattattcctacacctaaccctaaacggacataggttttgataacatcggcatctgtcgctgtgaaaacaatgttaggcaataaccccgcactattaaaagcatagtctaaatcagatccccctgtaaaaccaaaggtataagtcactagaggatattgaccaagtgcttcaattgtcaatttcttacattgtgccaaaggatgttctggtttgacaattactgagcgattccacatataacaaggcaataaaacaacgtcatcaaaaagatattgtgcttctgttgtaattgcaaaatcaacctcaccgaataaaagagcgtcataaatttgcgtaggagaaccttgatgaatatgtaaacttacttccggatattgtttagaaaaacgtctaatgacggaaggtaacatataacgagcctgcgtatttgttgtcgcaatacgtaaaactccacaatttggacgagtatattcattggcaattgctttaatattttgtgttttaactaataattcccttgccacggcgacaattcttgcccctgccggtgttaggcctttaatatgtttaccgttgcgttcaaaaatctctaaacccaactcatcttctaacaacctaacttgtttactgataccgggctgagaagtaaacaatgcgttagccgcatcagtaacattcatattttgattaacaatttcaacaatataacgaaattgctgaattttcatagcaatacctaaaatctcaatgagaaaaaaggtgcgtcaaaacacaccttccatgaaaaatttattgtggataacgagctgcgacttcagataatagagattgcaactctccctgttgaaacatttctaacattatatcacaaccaccaattaattctccctctacccacaattgcgggaaagtaggccaattagcataattcggtaatgccgctcgaatatccggatgttgtaaaatatcaacataaccaaaagggacattacaattaattaatacttcaaccgctcttgcagaaaatccacacgacgggaatttaggcgatcctttcatataaataagaattggattctcactgatttgttttttaattttgtctaaagtttccataatatctcttataaggtaaattcgggctgaattgtagcataatacaataaagccctaaataaatatttagggcttataaaatctactaaaggataacgatattatttgctacctttcactgagatttcaacacgacgatcttctgccaaacatgcgattaatgctttgcgacctttaaccgcatcacatttcataccggttaccggatttgcttcaccgtaaccaaccgcactaatggcatcttgagcaacacctttagagactaaataatttgctacagtatccgcacgacgttgtgataattttaagtttgacgcatcagaaccgatacggtctgtataaccggcaacagaaacttgtgcggtttttaattgtgcgatttcaccataaacaccgtccaatgtttgttgagcttcaggttttaatgtatctttagcgaaggcaaaattcacatctgaatttaagctgaacactttgtttactacttcaggtgccataaccggtttttgaccgaaacggtaagataagccaagtgttactgcaccgatacttggtgtatagtctaagcgttcaccatctttcttacgtgctttaccaacgcctttaacccattgatattccaaacgtaatgccaattccggtaaagaaggtaggctgtattcaacacccgccgcaaaaaccggagaaacttttaaagtgttttttacaccgtctttttcactttctaaatgtttaacatcaacataattagaacgaattaacgccgcacctacacgaccgtaaatatccaagccttctaatacagggtagcttgcttttaagcctaattgcatcccttgagcggtatgtttagcttcttttttctctttacgaccttttgcttgaccgaaatactcagaacccaactctacagcaacatgatcggtaatttggtaaccaccaaaaataccataagctactgaattacgaactgttcctttcttttctgcagaattttcaaattgattaagaccgtcatggaaagatgcccaaccggctttcgcaccggcatagaacgtatttgcttgaggtgccgcttgtacagaagcaacaaaacctgcgatagataatgcaataattgtttttttcatttgaatttcctctatattaattatcaagaaattaagcactacatgtattccgaagatttaaacatctctaggaattaaggtgggattttaacctaattttacaaaaaagataaattttttctctgatttatcttattgaagcctaaaatttaagcaggttttccattttttttgctttaactaagaatgcttttctttcatgacttgccatttgattacttgttcccggtaatttcactgttaacgggttaacaggtctaccgttaatatgaaattcgtaatgtaaatgagcaccggttgaacgtccggtatttcccgataatgctatacgttgtcctctttttaccgattgccccggtttgactaatgagcgacttaaatgcatatagactgtctgatattctttgccatgtctaatcatcatataacgtccggcaccgttagcctgataagcgactttctctactactccatctgccggagcgatgatagtcgtgcctacaggtacagcaaaatcaacccctttgtgcggtcgtatttttcctgtaacgggatgacggcgagcaagattaaaaggagaagacaccctagcttgacgtaataaaggataacgtgcgaaacctttccctaaagtttctccctgacgactataatagcgtccattatttgcttggattgcgtaataactttttccaccggacataatatgtatggcttcgaccttgccttgcccagtcaatttattatctaaatactctctcgaaactaaaacggcaaacttatcccctttttttaacttattaagacttacctgccactgaagtgcggtagttaattgagcaatttgtttactgctcaagcccaaggctttcaaactggcataaaatgatccttctatctgtccttttagaacctcttctttccaaacacttttcttttctaaaatttgacgtttaaactgagattcattaactcgctcataaatacgttcttcacgttcggaaacaagccaatttaaatattccaaatttccatcattatccaatatccaataaatttgttgaccagctttcagattttttaattccggataactcgccatcatttgacgacttatttcctcatccaaccctgaatgttccaatacatctttcaatttatcgccacgaacaactgtatgtgcaaattgatctttaatacgcattgcttgatctgcagcatctaataaactatttaaggcctctttggcattatcaggcaatgatgatatttcattatccaaattaacttgatccgtttcatcatctaaaccgtctaaatcatcataagacaattcactgttatttttttcatttgcaatttgcatatcaacagatgtaggcttctgagaagaaacatcgtttctcaagaacaaccctatacccattagaataaataaaatagctacaaaaaaaacggcaacttttatgtagaatttctttttgcgtctatctctagctaatttaatgtgctgcaccattctaataacaactctataaaatttcagaacttcaataagaccgagaattgtactaaaaattcatttcatttcataaaaaaaattatacacccgcataatttatagacataaataattactacaccttgttaaaataaaaaaaataagctatttttctacttcaattttacctcagacatttgtttattatgcaaattcactctctaaaatatccattaatcgaattaaaaggcgttaatgtaacattcgcacaaaagaatattctaagcgatattaatttaacgatttatcccaattccattatgaccattgtaggaccgaatggaggcggaaaatcaacattactcaaagtactattaaaactgttgccagccacaagcggtgaagttatttatagcaaaaatgtagtcattggttatgttccacaaaacatttatttagacaaaagtttgcctattaccgtagaaaaatttttatctttaagaaaagggacgcataaacaagatataaaagatgctttaacattactttccattggacatttacgtttgaacgctatgcaaaaactgtccggcggtgaaatgcaacgtgttttgctggctagggctattttgaataagcctaatttacttgtattggatgaacctactcaaggagtagatataacaggacaagcagaactttatcaactgataaagcaaactcaacaacaactcaattgtgcaattctcatggtttcccatgatctacatcttgtcatggcagacacaaacgaagttctttgcgttaatcaacacatctgctgtgcaggctctcctgaggcagtatccaatgatccggtttttattcgtttctttggcaatcaattcgcaaaaaatatcgctttctatactcatcaccataatcataaacataatattcatggtgatatttgttgtggtcaagatttccggtctacacaatgtaaacacaaaataaattaaggaataaaaatgcttgaaattctctttcccgcttggctaaccggaatattactctcattcattaccgcacctttaggtgctttcgttgtttggaggaagatggcttatttcggtgatacattggcacactctgccttacttggtgttaccttaggcatttttttacacatcaatccatatgttgctattctaatattaaccgtattattagcgatcttaatggtttggctggaaagtaatacgcaatattccatagatacattattaggtattattgcacatagttgcttatctcttggagttgttaccgttgctttactgcaaaatgttcgtgtagatttaatggcttacttgtttggagatttattggcactgggatttgatgatctctattttattgccatcggagtaagcatcgtattaggaattttaatctttttttggcaacctttattatcaattaccgtcagtcctgaacttgctcaagttgaaggcattaatatcaaaagaatgcagtttctattaatgattttaaccgcacttaccattgcattaagtatgaaatttgtaggtgctttaattattacttcattactgattattccggcggcaacggcaaaacgttttgcaagaagtccggaaatgatggtgattattgctatttttgtgagtatgatttctatcacattaggactaacattatcagcattctatgataccccttccggtccttccgtcgtcatcagctctacactcttatttgtcctttctttattcaaaaaagaaaataattaggtaagctacaataaaaagacgcaaggtaaccaaaataccttacgtctttctttttattattgaaaaattaatttatttccagagagtaggatcaacgcctttacgaagtaattgagggtattgttcaattttaaattcaggatctttacccgctttgagctgttggcggtaatcttttagcaacaacataactatcggtgccaataaaacaatagacacaaggttaattaatgccataatcgccatcaccgtatctgcaaagttccatacaatatttcctgaattgactgcaccaaaatacacaaagaacaacacaattaaacggaaagtgagaataaacaatggtttattgcgaataaaacgaatgttactttctgcataagcgtagtttccgataatagaagaaaatgcaaataacaataggataaaagctaagaaatgtaagccaaattcaccaacatggtactgtaaagcatattgggttaatgaaatgtttttcagttgttcgccaccataattatctgataataaaataatcaccgcagtacaagtacacacaataatagtatctacaaacacacccagcatttggatcaaaccttgacttacagggtgcttaacatctgccgatgctgccgcatttggtgcagaccccatacctgcctcattagagaaaagtcctcgtttaattcccattaacatagctttagaaaaaattgcaccgaacataccgccagccatcgcatcaaaattaaaggcactctgaataatacgacttattactgtcggtaccatttcaatattcatacctaaaataatcaccgcaatgattagataaaacaacgccatcataggaacaatctgagcagaaactttaccaatacgtttcactccaccaaaaataattaaccccgttacgataacgagagttaacccgacatagtgcggttgccatttccaagcattttttgttgcctcaacaatagcattggattgaactgcattaaacgcaaatccgaacgtaaatattaaagcaattgcaaaacatactgccaaccaaggagctttcaatcctcttgtaatataataggcaggtccgccacgaaataacccgtttttatctttaactttaaataactgagccaaagaagattcagcaaatgcactggacattccaatcaacgccgttacccacatccaaaagacagcaccttccccgccaagtgctattgccgttgcaacgcctccgatattacccacacctacacggctggctaaaccagtagtaaatgcctgaaatggcgttaaagattgtccttgaactgcccgtccaaaccacatttcacgcaaactttgtggaaataaacgtaattgaataaagccggttgctaacgtaaaaaacacacctacaccaagtaatgtaatagtcgctaaatcccatagtggtccatcaaatttatcaacaaaccaacttagtgcttgttcaatgtttattattatagttgaaaacataatctacctcccattaaattgaaacgtgagtatttaaatacaaatttaaaaaaaacaaaaacaaaaataattaaaatataaaacaaatattcttcaattagaaaaaatctaatattaaagcgtttaattaaataaaaaacaataaaaggaggttctacttttgaaaaaatactaatctcttgataaaaagagtgccgccgcacctcgtacaccgccggaatcaccaaattttgcttttttaattaacggtactttcgctgtacgcattaaatgctgcggtaatgctttaggtaatgcttcatataaataatcaaagttggacaagcctcctcctaagataatcacatgcggatcaagtgcggtaataatattgccaattgaaatcgcacacagctcaataaaaagttcaacaaatttaaccgcactttcgtctttgtcataaaagcaccgaataatttctttagcggataacgcctttccttgtagatcacgatacaacatttcaaaaccacgaccggataagtaagtatccaagcatgctttattgccacaaccgcattcataaataggtgctttatcccaacctaacaatttcaaggcgtgataattaagttgcaaatgccccaattcgcccgccataccgctttgtccggaatgaactttgccgttaaatactaaaccgccgccaaaaccggtacctagaatcaaacctaatacgacaggatattgctggttatctttatcccaagcctctgacaaggcaaagcaatttgcatcattttccgcccgcacttctctacctaaacgctcagatagatcttttaaaataggtttattgtcagcaacacgaatattagtaatctctgcaataccggtttcctgattaacaaatccgggaacgccgatgccaactgtacctttacaggcaaatttttcatcggctttttgcactaaatgggtaatgacatttaaccattcatcataactgtctttgggtgtatccactctttcggaataacgtttctccaatttttcattaaatacagcaagctcaatttttgtgccaccaatatcaaatccgtaatacataaatcctccaaatataaccaataccaaccgcacttttatatcttgtcaaaaacaaaaatatcttttctttgtaaataagcaaatataatcaaatgcacaaaccaagcgattaaaatagaagccaatagatcaataggataatgcatacctaagcgtaatcgactcactaacattaacaccgcccacacagttacaacaggtactagcaatttaattttagggttgcgatgaccaagtaattgtgcaaaaccaacaactaatagcagccaagttgccgcaaacattgtatgtccggaagggaaagaataacctgtttcattagcatgatgttcgatcagccaatcaggtgcggtctgttttgtctttgtttcttgataatattgatacactatttttttccgctcacggcgtttttgtgcataaaaatcatctgtactcatgtctgaattctgcactatttcttgcacaaaaggacgaggttcagaaaacattgtttttaaaccgctcttaatgccttgagtcaaaataactgaacatgccataatcacaattgcccatattgcctgttttttatcccgaattgcaacgaaataaaataaagcaaatgcaatacaagtgatgattgcataaggtgtgctacccgtttctgttaaaaaatataaaaaataatcaagcgaggcaacttcattaaattgccagtgccaatcaatgaagtaagtaaaaattggtacaacgcaaagtaataaagtatataatgaaaaacgttttaacatcttgataactcataaaatgaacttatataaggctcttgcattttaacattatcaagttataaaaagctaaaaataagtataggtattttattatgtccaaaattcagttagttgctgaagctaaattacccaccgagttcggaattttccgtattgtcggctttgagtttccagatactcaaaaagaacatgttgctcttgtaatgggcgatattaatgatgataaacctgttcttgcacgtatccattcagaatgtttaaccggagacgctttacatagcttaaaatgtgattgcggtttccaactggcgaccgcattacgccaaatcagcgaagcaggacgaggagtattgatttatcatcgtgaagaagggcgtggtattggactaattaataaaattcgagcttacgctttgcaagatcaaggattggatacgattgaggcgaaccttgctttaggttttgctgctgatgaacgcaatttttcggtttgtgccgatatttttgcattactgggggtgaaacaagtacgtctgctcacaaataatccgaataaaattgaaaccatgaaaaaatccggtatcaatattgtggagcgagtgccattgaatgtaggtgaaaaccgctataacacagaatatctagatacgaaagcaaaaaaaatgggacactttattgtgcataataatgaacaacatttaatcacttgtccgcattgccaagaagaaattccgaaaaaataattttcataggttggcattccccaacctatatttttaactaagttgtccaataatttatttttctatttaatctttctcacttaattccggtattatgtagcagttgcacaaagaccaaaattcaatcttgaccgcaataaaatttctgatgcccttaactctcaaaatagcgttaagggcatttcttttgcttaattctaacttattttcccacacattagacaaaatttccttatcgcagacgtaaccaatcctctcaaccttgtaaaaggtaagcaactttcactaatacaaataggaatgtgattttgcgattaaaagttaagctgcaagtaattcctgttcatacttcatcatctcattgagatttttgaagtaggtttgggagatttcttcaggactgaaagcggtcataccaataagctcttgggtacggtgattaccttgccaatagcctacccattctcttaatggtaatacccataaacagcgtttaagaatattattgaacagctcaccattagactttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcctttatccaattattcctagaaaatccatagtaaaggtagcagaataatgtgtaatttttttagtaggttaaaacagcattttcgcaaacatccttgttgctgtgtttcattagcatttttacttctattattactttggttagcagatttacttcttgttcaaatcatcactcctttccgttgtgatatgtggaaaggcaaagagctagaagtttttttaacccccgaagaatggaggaaactatcgggcgttaatgaatcattaaaagatactgagtggatacattatccagctattgagggaaaagcagaaaaagatcctttttttataaagaataagggggtatatcagccagtaatgtattttaatggtgatagacattggctaagtgaggttaatagtaaatacccttacttaaatatatatatcccaaaaagatactagggcataatacatttatcttatacgatcaaaatttaaaaaaaagaatagtccagtataatatcataagaggctatttccgtgatcctttttttggggtatcggggagttttgattgtaataaaaatgctatgtcagatggctcagatctgatagaagattatttaaaataactagagaggtaagatatgtctaatgataatttggcgttgttggctgctgctgcgtatggcgaattctctgaaataaataatattaaggaaattcagaaaaccttaataaaaaaggctgaagtatccgctactcaagctgaaaaatttacagatacttatgaaataatcgctcatcaagcaaacacggctagtggctattcagggactattgttaaaaataaatattttacatagagagatattatgaaaaaaaagattcttgccgtatttttaagtattattacgattatatttatttctacctatccttattcattttggcttagtgaagtagttgttagaatggtgattgctgaatttgaacaaataatatttccaattaaaagaacaaaagttttgaatagcaatggttttaatataaaagaagaaatatgtatcccttataaaagtttttttggtgagtatgcaattaatattgatctaaaagataaatcgctaaaaccatttgagacaaaaagcgttttattaaatgattttgatttttatatatctatatatgatgataaaaaccaattattattttataacagccctcaagacatcagagataagtcgagagaaaaatataattctgtaacactaaatgaatatatttttcctaaatcagggtgttataaggttaatgttgaaagtgtagatgtaaataatagcaagtataaatatttatatttacgtatttttataacacataccattccttaaattaagataaatgtaggtgattattatgaaaaaatatactttagaagttaaaatagcagaaagaggaacctcatataaaggtcatagttcttctgttgctgggcatattttctatgtattagtagatgaacatggcaacagaaaaagttttggctggggaaaaggagagaattcaacactaggtggaatagagaacattactaaaacagatgacatcgattattcagaaacaaatttcggtggctccgatgatgatatgttatacggtggcgacggggcagataccttgcttggtgaaggtggtgatgattatttagatggcggagaaggcgaagatgttgccgagttctcgggtaattttgctgactataaaatcactaaaatgggtgatggcttattaattagcgacaccaaacaaggacgagatggtacggactttttacgcaatattgagaggctgaattttaaagatattacgaactatcaagtaccagtaaccaataattttaagccacaacttccctccttccaagcctaaataactatttaatcccccctcattaaaacctaattaaacatcatttaactttttgtaaaataaactgcgagacagatcacaaatttagcatttagttgtttgctattttgaaaaattccttatactcgctaaagaggtttttataccaaaacttaggaaaatttgatgtcttttattcgtattgtattgtgggtacttttaggctggttcttactttgggctgggaaatggggttattttatatataaagcacatgagtcgtttttgcctgacgtaaatattcctcttaaattacaaaaaggctataaatacgtgtttgaatatatccctccagatgcaagtttaaaagagcaaacatggtcattagagatagagggaataagttttaataaagaatatgaaagtcatctaaaaaacttaatgttaaatgatggtattgaacatataagtaaaattaaagaggggtatctttatccagcaccagtaataaaaactagagtaaaaaatctagaaacagatgaagtgtatgagaatgtattatcttttcaaaacaagaactccagccatgtatgcaatgaaaccctacaaaatatttggtgttatcattatagagctgatgtactcacaggacaacgttggctaagatttttccctaataatagatatttaatagaaattgaagttctttattctgatattagacaagcaaatttaaaatcaaaacttgttctaggtgatgcacatttaaaaaaaacatatcgtttttaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatacgataccgcacaattccaatatcgtactcgccgccgccgttttaccacaaattcagctaccttaattatccgtttactcaaaacagagccacatcgttattggcgtgttgaagaaattacaaaagaaatccttattgcagataatcaacccaatacccctgtaaatcgtacctatatcaagaacgttcatgcggcaatggataggttgctcaaaaaggggattgtagaacgacagtcagataaagctcataaagtggctttatggcgattaaaaactgagaagtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggcggttacaattgagtgatgctgcgatttatgttcgattttcccttcaatctcaaatgctttaaacattatctcttttgctgacatccattggtttgggtaatgtttaaacacttttgcaatataatcgctagggtgataagcgtatattgaaatcacatttccattaccaatagatttagctttcctcttgataggacttgaaaacgggtcactctgtaatgccactaaggcttgttgtagagttacttgatgctctttcgccttttcaatacattgctcaaagtgagtaatttgttgagcaagttcagcgattttctgccgaataagggtttccccactcattcttgccataaataaaaatccttgtgatgtaaaataaccacaaggattttagtcaaatttagttaattggtctttgtgcaactgctacataataccgcttaattctgtgttaaaatccattttgcatttttaacccgatacaacggttacgaacaaatataggtaagataatgctccctagattaaaaaacattcctcaacttgatcctttagtttctgcctatttggaaaaattaaaaacgcaacattttgaaggtgatatcgcgacaaattatgcagaacgtttaagtttggcaaccgataacagtgtttatcaacaacttccacaagctattttatttcctaaaacaacaaacgatgtggtatgccttacaaagctagctcaacaaaaaaatttccaatctcttacctttacaccaagaggtggcggtacaggaaccaatggtcaagcaattaaccataatatcatcgttgatctttctcgttatatgacaaacatattagaactcaatgtggagcaacggtgggttcgtgtacaagccggtgttgttaaagatcagctcaatcaatttttaaaaccctacgggttgtttttttcaccggaactttctaccagtaatcgagctactattggcggaatgattaatactgatgcttccggacaaggctctctaaaatatggtaaaacttcagatcatgtactaacgctaaaatctgtcttaatgaatggagaaattttagaaacaagtgcggtcaaatctgatgaacttttacaaaatattcagcatttatcatcaacaggacaaaaacttcatcaagaaatctttcaacgctgtcaacaaaaacgctcacaaattctcactgatttgcctcaattaaaccgttttttaaccggctatgatttaaaaaatgtatttaccgaagatcaaagcgaatttaatcttagtcgtattttaaccggatctgaaggttcattagcttttatttgcgaagcggttttagacttaacacctattcctcaataccgcactttaatcaacatcaaatatagctctttcgatgcagcattacgcaatgcacctttcatgctggcggttgaagcattatccgttgaaaccattgatagcaaagtactgaatctagccaaacaagatattatttggcattctgtacatgaattacttacggaagaaaaagaaaacccaattttaggtttaaatatcgttgaatatgcaggaaacgacctcaccttaattcaaaaacaagtatctcacttgtgtcaactgttagacgataaaatagctcaacaacaagacaatattatcggttatcaagtttgctcagatcttccttccatcgaacgaatttatgctatgcgaaaaaaagcggtgggcttattaggtaatagcaaaggcaataaaaaacctattccttttgtggaagacagttgcgtaccgcctaaaaatctagccaactatattagtgagtttcgtcaattattagataaacatcacctagattacggtatgtttggacatgtcgatgcaggtgttctacatgtacgccccgctttagatttatgtaataaagaacaagttttgctattcaaaactatttctgatcaagtagcagatttaacaaaaaaatatggtggcttaatttggggagaacatggaaaaggaatgcgttcacaatacggtgaaaaattctttactccggaattatggcaagaattacgctacattaaatttttattcgatccgaataatcgtttaaatccgggtaaaatttgtaccgcactttattctgaacaagaactctactccattttgtcgccaatgcgggcagatcaagatcgtcaaattcccattcaaatgcgagaggaattttccggtgcgatgaattgtaatggtaacggattatgctttaactttgatgttcacagtgccatgtgtccgtctatgaaagtcagcaaaaaccggctattttcgcccaaagggcgtgcagcaataattcgtgaatggttgcgtttgatggcaaatgaaaatatctcgcctgaacagctgaattttcgtaaagtcgaagtgaaattaacagatcttgtcaaaaaaattcgcaatacggttgcccaaaaacgaggggaatacgatttttctcacgaagttaaagaggctatgaatacttgtttagcctgtaaggcttgtgctacgcaatgtccaattaaaattgatgtgcccagctttcgtgccaagtttttctatttttaccataaccgctatttacgcccattgaaagattatgtagttgcaaatgtagaaatgatggcacctttaatggcaaaagcaccgaaatttttcaacttttttacaacggctaaactcactcaatctttggctgaaaatctgctagggatgactgatttaccctcattgtctgttccctctttgcaacaacagttagttgaaataaattatcaaggttattcattggagcaactggaaaatctaagtgcggtagaaaaacaaaatattttattgattgttcaagatccgtttacctctttttacgatgcaaaagtcgtcgctgattttgtagcactctgtcaaaaattaggttacaaagcgattgttcttccttttaaacctaatggtaaagcaatgcacataaagggattcctagcacgttttgccaaaactgcaaaaaatcaagcggacttcctcaataagataagtaaactcggtttatctctggtcggtgttgatcctgccattgttctttcttatcgtgatgaatataaagaaattctcggtgatgaaagaggagattttaatgttatcactgctcatgagtggttgaaacaagaattaagttcagggaaacttgagcataaacttacacaaattatgcaaaaaaataaccgcacttttaataaagaaagtcaacagaaatggtatttatttccacattgtacggaaagtactacactaccgaacagtgcaaaagaatggcagcaaattttttcagcttttggacaagaattacaaaccaaaaatgttggttgttgcggtatggcaggaacgtttgggcatgaaattcaacacctagagatgtcaaaagaaatttaccatttatcctgggctaaaaaattacaaggaaaaaatcctgattattgtttagctacggggtattcttgtcgcagtcaagttaaacgtatgctccattggcaacctaagcatcctattcaagccctattatcaattatttaaatagaaagaacttgttatgaaaatttggaaaaaaaactacacattagaccagcttaaccaattaaccgccaattgtgccgttgcacatttaggtatagaattcactgctcaaggtgatgattggcttgaagcaactctccccatagatcatagaacaactcaacctatgggatatttacacggcggtatatcctgtgcattagccgaaacagtagggtcagcggcaggtttttgttgtgttgatgaaaatcaagcggtacttggtgcagaaatcaatgcaagccatttacgccctgctacaaaaggaaaagtgacagcgagagcaacaccaattcggataggaaaaaatattcacgtttggcaaatcaatctttacgatgaagaacggaaaatttgttgtagctcaagactaacattaagtgtgatagcaattaattaacaattaaataacgttgctcgttggctattaacaccaatccacaacgcatgatttaccattgacatcacaagataataatttaggaagttatacaatgaaaaaagacaataaaatactcggcgtagtgctaggcatagggcttattttagtggggatatttatattaaacagtcccttattgactttattgacaattatttcgtaccttgcatgggcagttttgctcagggggttattttccctctttaaatgttataaatcacataaaaatacccaaccatttgataaaacagaattagccgccggcatcgtcttaatgattcttggcgtgatattcttaaccaacccttcatttaccaatgcacttgtattttatttagtcgccttttggtttatacttgaggggattgtcggtatatattatgccgccaaacaaaaagaggcggtaaaatggattggtgttgtactgggtgttttactcgtatttttcggcttatccatttcagtagaaccgctaagagccatattggcacttaatctattgctggggttggcagtcgttacaaacggggttcaaattcttgtagctcaactgatgaaagagaaataaagggttaccgaatgaaaaaaatcggcattattcttgccaatttaggcacacctgacgagcctactcctaaagcattatctcgctatttatggcaatttttaacggatccacgtgtagtggatctacctaaatggcgttggtatccgttgctcaaaggcgttattttgccacgtcgatcgactcgagttgcaaaactctatcagtccgtttggactaataaaggctctcctttactcgtcatttccaaccaacaaaagcaaactctacaatcctacttcgatgaacatcggattaatgcgacagtagaaattgccatgacgtatggtaacccgtcaatggaaagcgcggttgaaaaattactggaaaaacaagtaaatgaaatcatattgttacccctttttccgcaatatagcagtacaactaccggtgccgtcttcgatgcctttgctcaggcgttaaaaaagcaacgcaatattgtgccgtttcagttcattcattcatatcatttacatgaagattatattaatgcactggtaaacagtattaagtctaaacataaaccggatgaatacttacttttttcttttcatggcataccgttacgctatgaaaatgaaggagattattatcgtaaacattgtcatgaaacagttttagctgtagtagaacgtttaggcttgcatgaaaatcagtggcaaatgacgttccaatcaagattcggaaaagaagaatggttgcagccttatacggataaagtgttggaaaatatttatcaacgaaatatacaaaaagttgccgtggtttgtcccggattttccgcagattgtttagaaacaatcgaagaaattaatgaagaaaatcgaagaatttttctctctcatgggggagcgtcttttcaatatattcccgcacttaatgcagaaatgcaacatattgaaatgatgtataaattaatctcaagtagattataaaatcaactggtaaaatagagctgtaaaatactctatttacatctaaaaacattaatcttaaaatgccccgtcatcgcataccactgtcagttaaatttgctgatttatctttctaactctcaacgaattaaaggaaattgagatgaaaaaattaactaaaatgactttagctaatctgattttactcggagcgattcaaacagcgaatgccagtgataatactgtgtatctttatacatggagtgaatatgtccctgaaggattattagaaaactttactaaggaaacaggcattaaagttattgcatccagtttagaatccaatgaaacaatgtatgccaagctaaaaacgttggggaaaaacagtggatatgatgttattgcaccgaccagctattttgtgtctaaaatggcaagagaaggcatgttaaaggagttagatcacagtaaacttcctgtaatacaggaacttgatcctaatatgttagatagaccttttgacaaaggtaataaatactctcttccacaactattcggtgcaaccggtattggatacaacgctgacaatcaaaatcccgaacaccttcaatcttggggtgatttatggaaccctgaatttgcaaataaactgcaaatgctagatgacccaagagaactatttaatattgcattactaaaaatgggggaaaatccaaatacccaagatccaaaggtaatagaaaaagcctatcaagaattattaaagctacgtcctaatattttagtttttaactctgataatcccgcaaatacctttattaccggtgaaacagatgtcggcttgatttggaacggatctattcgtgtcgcacaaaatgcaggcgtaccgattaaaattgtttatccaaaagaaggaaccatgttgtggattgataatttagccattccagcaacagctaaaaatgttgaatcggcatacaaactcatcaattacctgttaagtgcggatgtttccgaaaaattaacgctcgaaataggctatcctacttcaaatctcaacgctctcgaacgcttgccaaaagaattaaccgaaaataaaggtatcttcttaccgcaagaagtgcttgatcgaagtcaatggcaagtagatgtaggagaggcggctgaactttatgaaacttattatcaaaaattaaaaaatatgcaataaatacttccccgaaaagaactcatgaatgatccccgtaaactgcggggattttatttatcagataaactatttttaaatatttttactcaccaacttaaatgaagtttaattcgctttatattcttcaatcacaacaggtaaagtcaaggttttatctaaacgctgtatgaccatatttattgtggtattaggtttagtattactaatcgcttccatcatttgagcaggagaaacagcatcaataccatcaaaactaacaatcacatcaccaggctgaataccggctttatgtgcagggctaccttgtaatattgatgtaattaaaattcctttatctcttaaaccctttccattgctaaatagaatatcactttgcacccctaagtaaccacgaataactcgaccatcacgaatgattttttgcataacatcattagctaattcaataggaatggcaaaatttaatccttccgcaatttcgttggcattcttaccaatacttaacgtacttataccaatcaattcaccagcagaattaatgagtgccccaccggaattaccacgattaagaggggcatccgtttgaataaaattttgtcgtccaatgaaatcgccaacagcattacgacccaacgcactaataataccttgcgacacactttgacctaggttatagggattcccaatagataaaacgacatcaccgacatgagcttgacgttttggattttgtggaatggttgccagattatctgcatgaatttttaaaaccgctaaatctgtcaagcgatccgaccctactaacttcgcttcaaaaatacgtccattttgtaatgccaccacaatttgatccgcattttgaacaacatgctcattagtcaatatataaccatcttttgacataataacgccggaacccaagttattaatttgtggctggtagttattggttgtaaatgcaaaagcttgattataaacattaactaccgccggtgaagcaatacgtacagcatctttataagaaagaatatctttttgtataaaaaaaacatttgtcaaatactcatttcccttgaaaacaggcaatataagtaacaccaatgctgcggcagctaacccagtgattattgattgaattaatttttttatcattatgtgattgccctcagtatcataaaatgtgacgctgataattcaacttaatgtcttcgccaatttgtgccaaagataacaattgccactttggtgcatcggctaaacggttcaaatgtggtaagtgacaaaagccacgagctttattacccagtaatttcggtgccatataaataatgagctcattcactaaattttcctcaataaatgcaccggctaaagtttctcccgcttctaaccaaagactattaatctgacgctttgccaattcaatcaacaagttttccaaataagaatgctcgttacttgggaataattttatatattgacaataatcaggaaacgccgaaatatcacgttctttatcgccaaccaaccaaatgggagattgacattgaaataatttatgacgaggtgtcacaagatgctgacgatcaagaataattctgacaggttgacgcacttcttcaactttataattttgttgtaattccgatggaaattgctcccaacgaagatttaacaagggatcatcggctaacaccgtcttagctgttgataaaattgcagaaactttagcccgctcttgctgtacgtcttgccgtgcctgttctccgctaatccatttactctcgccattagccatagcagttcgaccgtcaaggcttattgccattttcaaaataacaaaaggtttctgtgttctcattcgtgttaaaaaacctttgtttaataattccgctttttcttgtaataatcctaccgcactttcaatacctgctgcttgcaacatagctaaccctttgcctgcaacttgcggattaggatctttcattgccacaataacgttgcgaatacctgcttcaattagtccttttgcacaaggaggcgttcttccgaaatgagaacaaggctctaaagtcacataagcagttgccccctttgctctatcaccggcatcacgtaatgccataacttccgcatggggttgccccgctttaaaatgaaaacctctcccaacaatttcaccatttttgactaaaacacagcccacagcaggattaggtgttgtggtaaatatgccttttttcgcaagatctaaagctatctgcataaaatattcatcttgagctgaaaatgttggttgcatcattaatcctttaatttttcaatttcattggtaaattgattaatatcatcaaaactcaaataaaccgaggcaaaacgaatataagcaactttatccaattctttcaattcagccatcactaaacgcccaacatcttgacttttcacatcacgctcacctgttgctcgtaattgataaataatgcgactaattgctttctctacatcatcagaactcacaggtcgtttttctaaagcatgttgaatacctcgacgcaatttatcttcatcaaaaggttcacgtgagccatcatttttgataattttaggcacaataacttccgcactttcaaaagtcgtgaaccgctcatgacaatatccacattctctacggcgacgaacctgataaccatcagaaaccaagcgactatcaatcacctttgtctcctccattgcacaaaaaggacatcgcataaaaaatccttaattaatcaaaaaaaaataaagcttatcttagcaaaatagacgtaacttgacgatatatttacatatcagtcaacaacgaaatgagagttcccttttagatttagaataaattttgacattcattttcttttaagcgtttaatgaaaaacatgttgtaccaaaaccatatacaaaacggtaccgactgcaatggataaaaacatgtttttttgccaaaaatgcagtactaataccacaataccagcaatgaaatcaggtataccacgatgacctgtcgtcagatcaatatttttatagcaatatactaccaacataccgaacatcgctgccggtaatactttgcctaaatagcgaatatattccggtacagggcgattagctggaaaaatccaaaaaggcaaccagcgaaaaagctgtacacctaaaattcccataccaatagtgattaactgctcatgaaaagtcacttatctctccctatctatccaatttagtcgccagtttttgcgataatattgaacggcgtaatgttaaatacaaccaaatgccaatcagtgttggaataagaaaaccctctttccctaccgttaataaagaaatcaatgcgattccgaagccaaataatgaactttcatgagatttttcttttaaccaattttcagcaaaaataactaaaaataaggctgtcattgcaaattcaacaccggcgagatcaaaaggcaaaatagaaccgaatagcgtacctaaagcagcaccaatgatccaatagcaatgtaaatataaactgacaaaaaagaaaaaccagcctctatctatattatgaggaatttttgccatatagtttaaagaaaaagcttcgtcaactaatgtggcaatcaaataccaccgttttttacccaaatctccgctgtatttctccagcattgagatggcgtaaaaaatctgccgcccactgaccattaatgtgattaataaaacgtgccaaggagaaaaagtactaactaatgctcctgcaataataaattctaccgaaccggcataaattaaggttgccattaaaataggataccaagttgcaaatccttgcactttcatatataccccataggctatgcctaaaaacatgaatccggcaagaataggaaaagaatgaggcaaggctacttttgccgcattccatacggtttttgattgattaagatctgacatacaataactattctaaaatagacaatccgggcaaggtagaaaaacgttgagatttaataatctcatagaaatcatcaataaaggcaacatcattatccgtttctcggaaagcaccatagagatcactatataacccttcatcagtaatttttcttgccacaacatagcctctatccaaataaggttttactgcccaaaacggcaatgtcgccacaccacgtttacttgctacaagttgaataatagcaatggttaattcacttgtacgtcgagaaggattgatgcctttaggatgtaaaactttacgtagaagatcgagcatatcatcaggcacagggtaagttatcaaggtttgctcaacaaaatcttctgcttgccaaacctctttccccgccaaaggatgatcctttgcacacaaaccaaccatttcataggaaaacaagggcttatgaataatacccggcgtttcttcaatttctgatactaccgcccaatcggctcgatgactcagcaataaaccaatagcatctgtatggaatccagacacaatatcaagttcaactaaaggccaatgttgacgaaaattatccatggcaggcatcagccaatcaaaacaagtatgacattctacagctatttttaactcgcccgcctctccttgtttaattctcgataaagctcgttcagtctccatgaccttaggcaaaatttcattggctaatttgatcaaccgctctcctgccgctgtaaaccgcaaaggatgacttttccgctcaaataaaggtaattgatattgttcttccaataatttaatttgatgcgaaagtgccgattgagttaaataaactctctttgccgccaaagaaacactccctgtttcttttaacgcaatgagcgtttttaaatgacgcaattcaagaaaaataggtttcatgaagattttgataacaaaaaacaatttgccgtattgtacagcaaaataaaaggatcaaaaaggctttctcctctttgacccttagtcaactacatcaaggtaaaaccaatctttaccctctccacactaagtgcggttagttattgacaaatttttcgcctaattcaatatcagctcgtaaagttggcaacatatcttctaaggctttttgttcaaatgcacttaaggtacccaccggtaaaatttcctctaccccttcttttcctaagcgaacaggttgtgcaaagaaacgagcatatttaccatcaccttcaacatacgtacattccacaacagtttcaccacttagcccctgtaccagtgagagagcaaaacgtgctgctgcttgagccattgaaagtgtagcagaaccgccacccgctttcgcttcaacaacctcagtaccggcattttgaatacgttttgttaatggtgctatttcgtcctctttccattcggtatattgtacttgggataacaatggaagaatcgtcacaccggaatgtccgccaattaccggtaccgcaatgcgtgaaacattgagtcctttcaattcagcaacaaaagtttcagaacgtaatacatctaatgttgttaccccaaataatttacgtttatcataaacgcctgcttttttcagcacttcagcagcaattgctactgttgtattaaccggattggtaataatacccacacaggctttaggacaagttttagcgactttttcaattaaatttttcacaatacctgcattaatattaaataaatctgaacgatccattcccggtttacgagcaacaccggcagaaattagtacaacatcagcgttttctaaagcgggagttggatcttcccctgcaaaaccttgtatcttcaccggtgttggaatatggcttacatcagccgcaacacccggtgtaacaggtgcaatatcatataatgataattctgaacccgcaggtaattgtagttttaataacagagccaatgcttgaccaatccccccagccgcacctaaaacagctattttcataagaacctccttatactcatacagttacaaattgaaccgcacaaattttaaaatgatcaagttcttatttcaaacaaagaaattaaattgtgcgatctacctcaaatttttaacaaaaattatttttaaatattgaaaactaagaatataaatataaaaattatctacctattttgcatttttatgcagcattccccaacgtcgatttaagagagaatacataatgatcaatgaaaaagcagatagcctagtcaacgcttttaaagaactactttcccaagaaagctttggttcccaaagcgaaattgttagtgctttacaacaaatgggatttactcatgttaaccaatcaaaagtctccagaatgttaacaaaatttggagcagtgagaacacgaaatactcgtatggaaatggtatattgtcttcctaatgaattgagtgtacctaataccggtagcccattaaaaaatctcgtgttagatgtagatcataacgaaacattaattgttatcaaaaccagtcctggtgcggcacaactcatcgcaagattactggattcggttggcaaatctgaggggattttaggcacaattgcaggagatgatactattttcgttacccccaccacaggaaatgatattcaggttttaattactaatatccaaaaattattcgaaagttctttataggattgtgatgaggaacataagatgaaaatattcatcacaggtgccactggcttgattggctcaaacttaatccctctcttactggaaaaagagtatcaaattaccgctttagttagggacatggagaaagctcgtcatcagctacctaatcaagttcagttggtcaaagcactgtctcattatgagaatttcaatgattttgatggcgttatcaatcttgccggagccccgatttttgcccaatattggacagccggctataaaaccgaactcattaatagtcgccttaatttaacagaaaatttaaccgcacttattaataacagtaacaaacctccacattgtttcatttccgcttccgcaacaggttattatggcgatcaaggaaataatctcattactgaagaatctctgagcggaaatcaatttaccgctcaattgtgtcaacaatgggaaaatattgctttacaagccaacagcagagtgtgtttattacgcactggaatggtgttttccgaaaaaggcggtgcattaacaaaaattctaccaatttatcgttatggagttggaggaaaactcggtaccggcaaacaattctgggcatggattagcttacaagatatgttacaagctattctgttcttgctagaaaatgcacaatgcgaaggtgcgtttaatctcgttgcaccaaaacctattcaaaataaagatttcaattgccaattaggtgcatggctaaaacgtccttatttcgcaacagttcctaaatttttacttaatttattattaggtgaacgagcgacccttttattagacagtcaaaatgttattccacaaaaattattggaagccggatttcattttagcacaccgacattcagcgattttttacattcgataaagaaataggacatgttatttacaaaaaaaccaccgcacttaataagtgcggtggttttttcttagagtgtagcaagttggctaaattaccactgataccccacrccaaccgaaccgccgacatcgcccgttgaactgcgagtaccttgyaatcgtagcgttattttaccgttatcacttactcgtgaataacctaacgccaccgcactttgtcctttataggaacctgccgaagcagcaaacatggatttacccggcacagaagacatcggcaaacctgaagttgccaaagcacccgcaatccctgctcgcaattctttattggacatatccagtttattgttgagattgctgagtttttggtcggcttgtctttgtaacgtatcyacatatttyttattcaccaccgcactttcaytsgtygwtgsytkaatatccggyacggtrataataccgttttcaccatcaatcttaatttcaccgtttgctccggttacggttaagccgtttttattaagaacarcttttggcatttttggattttgctgattttgtgtcgttacgttgtcagcaaaggtaagrctttcagcrgttattgtkgctttattgccagttttcttatcttccaacatgatattgtccgcaccatargtkgcmgakwtgtctttgyyrytaccatttttgttgttgacaacwkttaagccmtcgctatttaacgtsgmttttttaycgccmtcctctttggtttcaaaggctttcatatttttcaacgtatccgacagttttatttctaagccrtytttggctgtattggtttctaccttgatattgccagcrgcactactaaatgaacttgtagyttgacygttttgagtttcctcttcccctttaatagttaaggtatcgctgatttttctgactacatcatcgccctgatttcctttaaatctcaacccwgcttgtgcaaccgcttttaartcagcgagattrgcsgcttgatgcagrtcttgttgctcagtcattttttgcccttgctggctactyataccgtyrgaaaccagttttttcactagwtcaagggayttaccwtktttttsagawtcmgryttayctttcatactatcattatcaakyccyaarscggatttkagrttkttgatggcaacagggtcatgagccttacctccattttkaggtttaccgcctaaagtgattgattttttatgttcatcatcatatttcaccgctattttatccgcttctgtctgttggtcggtgatggtcttgattttgctgtttacaaagtctttcaccgccttagctgtagtaagttttttgtcctcagcactagaatttccgccagaaccgtccgcacttccattttccttaatttcttcagttgcctctattttgaaggaaattgttccggtgtcggcatcaatactcggtttgatatagtcatcgcctttaaatttaatcgtagccccaagctgacgggtcattttgttggttgatgtaccgccggtttgaggtgcggtcgtagttgctgttgtagtagtaccgttgtccacctcaaaaattaaacctttgttaatggtttcgatgtttttatcaatagcttctttaaatgtcgtnnnnnnnnnnnnnnnnnnnnnnnnnnnnnnnnnnaatgcagtaaatgtagttttcttaaagccatctcctctatcatttttctctgcacccaatacttccgtacccagttttccgaatacttgaataacgttgtaaagctgtccgccgttaattgcatcagttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaactttttgttgcttatcttcaactttcgtttcaatctcatctgttgttcccaaaacctgcaaggcttgactttgaattttaacagcaccttggacttttccgtttgaggattgagattgtccgctagaagacggcgtacttggagccgcactttgagcttgtccaccggcttgtgcttgtgcggtgttggaattatcagcttcaatttttagcgttaatgaattcaattgatttttcaagtattctttaaccgcacttacagtaaccagtttattgtcgttttggtcagttgtactgcctgaatttgtatcactaatagaagtagccactttgagcttaaaggtaattttaccaccgctgttatcaaggctaggcgtaaggtaactatccccaccaaacgttagcgttgagccaagttgacgggttaaaggaccgtttccactcgccattgatgattgagctccaccaccagtttccactgcaaattttagcccctcgttgattttggagatattggcattaattgcatctttaaatgtgtctttagtcgcttgatttccaccacttgtatctttcaatgcagtaaatgtagttttcttaaagccatctcctctatcatttttctctgcacccaatacttccgtacccagttttccgaatacttgaataacgttgtaaagctgtccgccgttaattgcatcagttgaaccgtcccttacttcacctgcggcgacatgggtgataatgcgttctgagcctgtagaaccaacgctgacgacttcttttttattgccttccattgtatcagcagaagcaccggcgtttttccagctgattgttacttcactttgtcctgtgttttgtgtagttccactaggtgcggtctttttcgtcacaatttgagaatttttacccaacgcaaaggaattgtcgccgttgccattaacattgataatatctaactttttcttcactgactcgccaagtttaatggtaacggttggctggtcttgtttaacttctgttttgatgaaatcaccatcaccttttatttccagttgggctttgtttaactcaactttaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtcggttgactccgcttcaaaggaaatttccccttttgaayyatcaaggcttgctttgagatgttgtccagttttgaaagttaccgttgcacccaattgacgggtcatttcrgttgartttccwgcagaaccgmccgcacttgtgccgttttcgactttraatttcaagccctcrttgattttmkcratgtttttggtaatagcgtctttaaatgttgttgaagctggatttgtctcagctccgtttttatctttcaacttagtaaacgtagtttgtttaaaaccggctttgttagtttcggctttttctgcacctaatacgtcggttcctaaatagccgaatacatcgataacgccttttaattgcccaccgttgatcgcatctgtggaaccgtccctaatttcacccgcagcaacatgtctaataactctttcacttcccatatcccctatacttagcacggattttttatcagaatcggatgcagatgttccagcattttcccatttaaataataggctataactgccattaacacttaactcttgtgttttaaatgcttgtttcttatcttctgccttagaacctttacctaaagcaatcgaatcccctgcattagtagatacagtcgcaccttccccaatcgctaccgctccggcagcacttgcttgaacagttgcatctttaccaatcaccaccgcactttcagcttgagaaattgcatgtttaccgataatcactgaatttttggcgtttgttattgtgccattacttccaccgttctcaccatttcctattatgattaaatttgcattttcggaacctatattaagattacttcctattgcaactacattactaccggaacgkgttaktgttattttrttwccyartgctayascccatkyrgmaytttctatttttgtttctcctgatacaccaattgcgattgaagcatcactactttccaatacttttgctttataccccaaygcyaaagattgwwytgatttaacytgagtwycygcacctasggcagttgaccatttagcatttrtwacwwwtgawykayraccratagcrayggmatcgtgtgaagtaccattttctacttttgcactcacaccaatcgcaatggaatttggggcttttgctccgtcgttatcaaaattgttgtttgtgcttgttgttgtggcggaagcggcggtgccatttcttaccgaaatataatgcaatttcgctgcttcaagttgtttaaagtttacggcatcgtcattacccaccccatcagcaacgcctgaaattttgactttcttacttccattacttccagtttgtgtaaatgttaaatcagtcccaccgacttttaacgtggcagttgatgtactatttgacccattactaaatgatagaatgttattattgtcttttcctacgctgttaataccttttaaggtgttattaagttctattgttaaattacttccagaagatttagtggtaatatttttatggttgccatttgaactatcttcttttcctttaatatttaaaatgtctcctaattttagagattgttctccgccagtatttccagcaaatttaagtcctttgtttatcgctgtgatggtgtcttcaattgcttctctaaaagtagacttcccagcattagttccatttccattatatgagacagctgtaaaagtagtctttttaaagccatctgttccagtatcggctttttcggcaccgagtacatttatccctaaattagcaaatacatcaattacgctttttaattgtccgccgttgatggcatcggttgagcctgattgcactgttccggcggcgacattcgttattattcgttccttaccgctgtccccaatacttaaaacagacttgtcccctcctgctccggcactactccaagtaatttttaggtcatttgcacctgcattagccgtaagtccagtcggtgcgatctttttcatttccgccttagaatttctccccaacgcaatagaatcccctgcggcggtggatacagacgcactttccccaatcgccaccgcacctgtggcgttggcttgaacattcgcacctttaccgagtaccaccgcactttgtgcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaatattattccccaacgccacgatatctgtrccgctgttgattttggttttattaccgatggctaawgaccattcrgcwtkmtytaattyygtatggtcagaaccatytccttcattaaccgcactgatagcgattgagccttttgcattgytgaatgtaacgccgttaccaacagcgacaacggcatcttgtttktytttactgtcttgtgtaaccgtaatayctgagcctaacaacacggaatgttttacatcaacattcaagtccttaccaatyacaatcgcttgttcrgcttttgatttcgcttcgtacccaagrgcgatggcatatttttcggtcgcttccgcacccacgccgatagcgatagcacccwccatctttgcaccatcgttgttgtagttgccttttgtaccactcgaaccgctagaaccrcyacctgcaccgtttgtaccatcattcaccgasarataatgcaaagattgsgtaccagtactgcttccgccacttccgccaccgcttgtaattttgctatttacatagtctttaaccgcttttacagttgttaattttttgtcttcgggattgctgttaccgcctgatgtgctgttaattgaatcagtcgcattgacgccaagcttaattgtgtccttaccattactaccttcagtgsttaaagtcagatagtcgtcgcctttaaagrtcaatgattgtccgagttgtcttttgatagtattgyygttactgctaccgcttccatttcccccaactttaaaggtcattccttggttgatagcattaatagcttcattaattgcgtctttaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaatsacrctatataactgcccaccattcaccgcatmggttgakccatcckcmacmttaccagcwgcracatgttttagtaggstttcgtttccaacatctcctactttaataacctgtttattcgcaccagtccctgcatttttccannnnnnnnnnnnnnnnnnnnnnnnnnnnnnnnnnnnnnnnnnnnnnnnnnnnnnnnnnnnaccccctctcgaaaataaatcacttaaccccgyggctttgktgattttttgggttatatcgtcgttgagtttgattttgatggggytacttgaacaattgtgtattmcttgagwgtttrmacymyyaaatccccctcctrctccattrytttgtttmmtacaastaaatgakyytmcatytacmtcgataaaaccytctccctktatccccgttttcatcatattttckacatctytcgcttcaccatcttgtaatcctgwaacaccgggkgaaaaactttgtcccaaaacctcyacyggcaacrccaccgayaacgctaacrccagcggtgcgagtttaaacgcccckaaaacaccgaaaaacmcaccgcacttcggcttactctccgaactgctcgctatttggcgattacttgccaactcggaaacggctttacattgacctgttgtaatatcatatttggttttgaagattttgttcatattctttactcactgtttgtttattcatctgtttttttkggtttttgttgtgtttttatatttatagagcggttataaacctaagcggaaaattgctttgctttttaaggcatagcaaaaaaagacgaatgatattttcgccgaggggttgaaaagggaaaatggggatatttttaaaggttaataatataaaaaataggttgcagggcttgcaacaaggcgttagcctagrctgtagrctgtagrctgtagrctgtagrctgtagnctgtagactgtagactgtagactgtagactgtagactgtagactgtagactgtagactgtagactgtagactgtcatttttcctgttctattttatttgtcaagtaaaaattcttgctatcctatcctaaatttttatagaaagaaatgatttttttactttttatcctaacttgattgaggcgaacaattaaaatgtttgatattcaaagaggattaaatcatcaccgcactttttagcataacgaaaaatcctagctccctattgggtaagagttcacatttatatggcacgatcagataaaatggaatgcttaaaagtgcggtacattttacagagatttcatttttctgttgttcttacgctgagaaatagcgataatgtgcgatctagaaaatccattgaagacttatgatagattatattttactgattattagtaccgcactgattaataactttgttctagttaaattcttaggactttgtccgtttatgggcgtttcaaaaaaaattgaaaccgctattggcatgggattagcaacaatgtttgtacttactgttgcctcgttgtgtgcttatttagtcgagcgttatttgcttactccactccatgcaaatttcttacgcaccttgatttttattcttgttatcgctgttgtcgtacaatttactgaaatggtcattcataaaacgagcccaacactttatcgtttactaggtatttttctccctttgattaccactaattgtgcagttcttggcgttgcactgcttaatataaacttagctcataacttaactcaatccgtcatttatggattttccgcttcacttggcttttctcttgttcttgttctgtttgccgctttgcgtgaacgccttactgcggcagatattccccttccctttcggggagcctctattgcgttaattaccgctggactaatgtctcttgcctttatgggcttttccggtttagtgagagtttaagcaatggcaacattacattatgttctgctgattatcgttttacttgccgctctttttggggcaattttaggttttgcctcaattaaattaaaagttgaaggcgatcctatcgtagaaaaaattgatgcgttgttaccacaaagtcaatgtgcacaatgcggttatcccggttgcaaaccttatgctcaagctattgcgaatggagatgaaatcactaagtgtgtacctggtgggcaaccattagtcatcaaaatagcagatttattaggcatagaagcacctagcggtaattttgaaaaagatcccctacccaaagtggcattcattgacgaagatatgtgtattggttgtacaaaatgtattcaagcctgccctgttgatgccatcattggtacaaataaagcgatgcacaccattattgccgatctttgtaccggttgtgaactttgtgttgcaccttgcccaacagattgtatttcaatgatcaacgtcaaacaacatattgataactgggattggaagttcgatcctaagttagttattcccatcgttgatactacttcagcacaaaagaaaatcgttgtaggagaatagggaatgacacagcgtatagatatattaaccaattacaattcaggtaaactttgggatttttatggaggtattcatccgccggagatgaaatctcaatccaatcaaaaccctataaaaaacttgcctttagccaatacattttatgttccggtcaagcaacatgccggaagtgcgggtaatattttggttaaggtaggagatagagtcttaaaaggtcaagccttaacgcttggctcaggtttaaacgcattgcctgttcatgcccccacatcaggtattatcaaaaatattgccccttatgttgccgctcatccttcaggtctatgcgaattaagtattgaaattgaatccgatggattggaacaatggcgaaaacgccactcaatagaggactttttaacacttagccgagaacaactcattgataaaatttatcaagcaggtatcgcaggattgggcggtgcggtttttccaaccgccgccaaaattcgatcagcaaacaataaagttaaactattaattattaatggtgcagaatgtgagccttatatcacttgtgatgatcgcttaatgcgtgattacagtgaagaaattattgaaggtatccgcattctccgttatatcttacgtcctgaaaaagcggtgattgcaattgaagataataaaccggaagctatcgcagcattgcgacaaagtttgcatggtgctaacgatattgatattcgtgtcattccaactaaatatccttccggtgcagcaaagcaacttatccaaattctaactggatttgaggtagcaagcggacaacgctcatccagtataggtattttaatgcacaatgtgggaacagcttttgccataaaacgtgccattattaatgatgaacctttaattgaacgagtagttaccttaaccggagataaaattgcacaaaaagggaatttttgggttcctttgggaacgccaatctcccatgtactaacacaagtcgcctatcaatatgattcacgtttccctgtttttatgggtggacctatgatgggattcatcttaccgaatttatatgcccctgtaactaaagcgactaactgcttactggcaccggatcattttgaatatgaaccgccggcaacggaacaatcttgtattcgttgctctgcttgctccgatgcctgccctgtacatttaatgcctcaacaactgtattggtttgccagagcggaggatcataaaaagtccgaagaatacgccctaaaagagtgtattgaatgtggtttatgtgcctatgtttgtccgagtcatattcctctcattcaatatttccgccaagaaaaagcaaaaatttgggaaattaaagaaaaggcacaaaaatcagaagaagccaaaattcgttttgaggctcgtcaagctcgcttagaaaaagaagaacaagaacgcagagcaagggttaataaagcagcggaaaatcgccgtgcagaaatggcacaacaaaaaggaattgatccagttcaagccgcacttgaacgcttaaaagcgaagaaatcaatcgaaacacgtgaacacaaccaagaacagaaaacgtttataaatattaaaggcgaaatattgcctgataacagcgacatcatagagcaacgtaaagcacgtcgtttggttcgtcagcaaaccaattcaaacagcattcaagaaattgaaactgttgtacaaaattcggagaaaaatacagaaaaaagtgcggtacaatctggcgtagatccgaaaaaagccgctgttgccgctgctattgctcgtgctaaagcaaaaaaacaggcttcacaaattactgcaaatagtattttggagcctgatactacaatacaaaatacagaaaaaagtgcggtgcaatctgacatagatccgaaaaaagccgctgttgccgctgctattgctcgtgctaaagcaaaaaaacaggcttcacaaattactgcaaatagtattttggagcctgatactacaatacaaaatacagaaaaaagtgcggtgcaatctgacatagatccgaaaaaagccgctgttgccgctgctattgctcgtgctaaagcaaagcaattagcaaaaaaacaaattgaagttaccaataaatgaaacaaagagattttacatgtttaaaatgattagctccccacatactcattcggggaaattgacagcccgcataatgttatgggtgattgtggcaatgttaccggcaatcgcagggcaagtatattacttcggatttggcgttttgatccaatcactgttggcaataagtacggcgttatccctcgagtttgttgtaaccttattgcgtaaaaaaccaaaatttttttatattggtgattttagcgttgttttgaccgcgcttattctcgcagttgccattccgccttatgccccctattggattattattatcggtacctgttgtgctgtaattttaggtaaacatgtttacggcggattaggacaaaatttatttaatccagcaatggttggctatgtcattttgcttatttcatttcccctacaaatgacaacttggttacctccaattcaactgcttaacgaaccacctcattttgccgatgcgtataaactcattttccaaggtgttaccactgatggttttaatttaagccaattaatattggctattgacggtatgagccaagcaacgccattagacacagttaaaacagcgatgcggaacaatttatcttcattacacgaagtcagctcatcacctattttcagttcggttctaccattgggcaaaagggatattgttgaaggaatgggctggacacaaataaatttactcttttttctagggggtatcttcctaatttggaaaaaaattattcattggcaaattccaaccgcacttttagcaacaatttttagttttgcattgttgaactggttattttccccagtcacaccaaatcccatttggcatttagtcagcggtgctacaatgttcggtgcattctttattgccacagatcctgttaccgcctccattacaccgagaggaaaactcattttcggtgctttagtcggattattaatctgcttaattcgtttttggggaaattatcctgatggcgttgcttttgctattttactggcgaatatttgcgtgccgctaattgatcattacactcgtccacgtgttataggccataacaaaaaaggaatcaaacaatgagcgttacacaaataagtagaaaatatggcatattattgggaacagtcgcctttatttgtaccgcactttccggtgcggtatattggctcacgaaggataaaattgcttttgcaatcgctaagcaagagaaaatgctgttagctgaagtaatgcctccaaattattatgacaatgatctgttagccgactgcaaaatgctctcatcttctttggcaaaagaatatcgtattaataaactttgtacagcaaaaaaaaatcagcaaattagtgcttacgcttatgaaactatcgcaccggacggctactccggcaatataaaaatgttggtcgcaattacacgacaaggcgaagtgctgggcgttcgaattacggaacatcaagaaacccccggtctaggcgataaaattgaattacgaatttccgattgggtcctgaattttgcccataaaatgttacagccaaacaatttaaacgattgggcagtcaaaaaagacggcggtcaattcgatcaatttaccggtgctaccattacgcctcgtgctgttgtaaatcaagttaaaacttctgggataatacttctaacacaacttgataaacttgctgtggagaatgaagaatgagtacaaaaaatctacccgaaacacaccgcactttagatgaatttgaaccctctcatttgactgtaaacaaggttaaaaccgaaagtgtatgggtaaatttatttaaacaaggattttggcataacaaccctgccctagttcagctattaggactctgccctttacttgcggtatcaaattcagcgacaaatgctttaggtttaggcattgcaactattatcgttttaatttgtagcaatactgtagtttctttgtttcgcaaacaaatccctcaagaaatccgtatccccatttatgtgatgattattgcgactacggtaacgatagtgcaacttatcatgaatgcttatacttacaccctttatcaagcattaggtatttttattccattgattgtgaccaactgcattgtgattgggcgtgcggaagcgtttgcctcaaaaaataccgttttacattccatttttgatgggtttgctatgggacttggcatgaccttcagtttgtttattttaggtgcattacgtgaaattttcggtacggggaaattattttttggtatagaaaatttatttggcgactgggcaaaatgtttacaactgaacctatttcaattagacaatagtttcttactggcaatcttaccgcccggagcgtttatcggtctaggcattatgttagcaataaaaaacgtgatagatcacagaaaatgaataaacaaaaacgtatcgaaatattaactcgtctgcgtgatcaaaatccgcaccccacgactgaattgcattttaatacaccttttgaattacttattgcagtcattctctctgcacaagcaacagataaaggagtaaataaagcaacagataaactttttcctttagctaataccccacaagccattttagatcttggtttggatgagttaaaaaaatatataaaaacgattgggttatacaatagtaaagctgaaaatattattaaaacttgccgtgatttaattgaaaagcacaatggtcaagttccggaaaatcgagaagcattggaagcactggcaggcgtaggcagaaaaacggctaatgttgttcttaatacagcttttggtcatcctactattgccgttgacacacatattttccgagtgtctaatcgtacgggatttgctcccggaaaagatgtcgtaaaagtagaagaaaaattattgaaagttgtaccatcagagtttaaagtggatgtacaccactggttaattttacatggtcgctatacttgcattgcaagaaaaccgagatgtggctcttgtattattgaagacttatgtgaatttaaagaaaaaacagagatttaacataaattataaatagaaacgaaggtataacattatgacaaacaccccaaaaagacaaacttggtccagtcgattaacctatgtcatgacagtagccggagcaaccgttggatttggtgcaacttggcgatttccttatttagtaggtgaaaatggcggcggtgcttatgtactgctcttttgtattgccatgttagttatcggcattccaatgattttagtggaaaatgtcatcggtcgtcgcttacgtgttaattcaattgatgcattcagtgataaattagaaggaaaaaatatttctaaagcgtggaaaattattggctatatgggattactcggtgcatttggtattatggcgtactatatggtacttggtggttgggtaatgaattatatcatcaatctcattaccggttccctagatatttcatcggtaattaacaaagaatatgcccaaaatttttatcaagagagtattactgaaagtccgctacaaatcataatttatacactgatttttgtcgtcattaactatattattcttgctaaaggaattattggcggcattgagcaagcggtaaaatatttgatgcccttattgtttatttgccttatcggtatggttattcgtaacgttactttaccgggagcaatggaaggaattatttattacctcaaacctgatttttctaaaatcacgccacaattgtttatcctcgtacttggacaagttttctttgcactaagtttgggatttggtgtaattatcacactttccagttacctcagcaaagaagaaaatctcatccaaaccgccgttataaccggatttacaaatacaattatagctgtcctgtcaggctttatgattttcccgtcattatttacttttgggattgaaccgaatgcaggaccaaccttagttttccaaagtttacccattgttttctcacacttatgggcagggcgtatttttgctgttgtcttctttagcttactgctcatcgcagccctaacaacctcaatcaccatttatgaagtaattattaccgcactacaagaaaaacttagaatgcgtcgtgcaaaagcaatttttatcacgttaggcacaattttcttaatcggtaatattccatcaatattaagtgataatttgttaaaagacgtcacattctttggtaaaagtatcttcgatacgtttgattacgtcagcggtaatattttatttttattgaccgcacttgggtgtgctatttttgtaggctttgtactaaaagaagatgcgataaaagaactctccccaaatccaaattctttatcgactcagatttggttcaattatgtaaaatttgctgtaccattaattattatcgtgatttttgtaagtaattttgtttaatctaaaactgtttaatttatagaggacactatgcaccatatatttatctcagataaaaataatgatatccgtcgtcatcatattgaaaatgaaactaaaaaattagggattacccctaatttttatgatgcaattatggcacgtgatttatcaaaagaagaattatcaacgcttactatccctaatacatttttaaccccaggagaaatttgttgtgcaaaaagtcatctggaggggggggggtaaaacgattgttagaaagcaatcaagaatacatttttatttttgaagatgatattctcttttctgataactttacgcctgaagtcattaacgaaattacaaactttatatcctctttgcaaaatccatctattctagttttatttaacagcatttataaaaagaaaaaagtaaaagatcttaatagtgctatatctattttttctgctcacaatttattctatgcttgtggctatgtcattaacagacaagcagcagaaaatattctaaacatccaaacgccaatcaagtttgaaattgatgcttttaagttttattactggttagatgcctgcgatttatattgtctaaatactgacttagtaaaacccgctccagaaatttcaaacttatcagagatagattgcgacaaccctagaaaatatacaaagcaacgcacaattaagaaaaataacgcatatcgtcttttatacaatcaactgagttggcaaaataaattaaaagcaaatataaagagaatacaaaaaatgttacataaaccctttgaaaaattgtagtttgtaatacattctgaatgggtagctttgtaggcagaaatcaataatctaactttttaggttagattatttctgttatttactcctttaagatacctaaattccaattttctgctgacgttggacgtttttcttgcaataagaaacgttgatttgcctttgcttgaggttgtattactttacttgatggtgtagagaaagaaataccgcctttaagcaattgctgcatggttcccgtattaatggacaatccgctcaagccaatttccacaccgtacccggaagaaatccaaaactctgtattttggcgaacaaagtgttggtatttcttagcaattaataaatgaactaaaactcgatcacctaattgatttagttccagtttagatatagtacctacctctataccacgatacatcacaggagatccgatactgatgtttgtggcatcagtggcttccagaataattggaaagccgttgccgtatttgtttgccggaggtacggacgaaagcaaattaaagtttgttttttttgcaccttgtccaatttctacatcaatataaggttgtaataaactatcaatattatcaatgccaccggctgaaatgtgcggtgaaataaggcgaaatttactgttttctttcgcaatgatattcatgtattttgcatgaattaatgcagtagcctcgattttatgatcttcggttagattaatttgctctatttctcctataggaagccccatatagcgtagtgccatacctttagtcaagtttgttgcatcatcagcaataaacgtaataacttgttctgccgatttggctttcatttcatttgcataaagggttttattgcttcctgagcctgaattatcaaaactgaccgcacctttcaaagaacgggcgataggggttgcctgaatactaatgccctttggcgttatatcaatttgtgtcgcactttctacccaaaaaagacttttggttgtaagtaaatgtttatgtttggggtaaataaaaacatcaacttcaaaatgattagccgttggtctaatatctaaaatcttaccaacttcatattgacgataaagtacaagcgagcctttatttatacttggtagattttttgtagttaacgtgatattaggctctaaaatattatcggtaataccgaattctgcactggttaaatccttatacaaaggatattcttgttgtgcttgtccttcctttttaccgcttgatataaccctaattcccccttgcaaccattttttcggactagcagcttccattcttaagccatcaatacccaaactaatatcaaagttactcgctgcaataaataatgtatttttatgaataagttgacgatatttttctgctattgctacttggaaaataacgcgttccagtgtactggtaatgttgacaatttcgccaatattttggtgattatagtaaagtggttgcccttctgtaataccgtaggtttcgggtgaaatgaggtttattactagggtattgggttgtttgagtaaaagctcgttttctttaatgacatgaaaagtcgtttgtgcttctcccataccggcaataacatcaatgtattttcctcgcaaaaaatttttcacatcggttaaatcgccgagcgaaagtttttgatcacgtaaaacaagaattgagcctgttttaaacaaatatttcatattcggatcaactaataatttcccgtgtaaaattttttcgctattttctaccgcacttaattcagataacacgccaatttgtatatcttgcgaatagattttagtgtgtccagcatctaatcctgctacattaggaacaataacgttgatttccgtacctcttttagcagcttgaatattttcatataacgtatagtgtgcattattttcagctctaggactttctcttggagaatcaaatgcaacagccccctgtactattgcgtttaagctatctgcttgaatattgatacctgataaacttaaatttgcgttgattccggtaatgttccaaaaatgactgtcttttttgacaaagtgagaataggctttgttgatgataacatcaacttcaacttttttctgatctttcgtgaaccggtaatcggcaatttgtcccacaggaatttttttaaagtaaaccgaggctccgctggataaagaacccaaatcatctgccagtaaatgaattaacaaatcaccatcattaacttgtgttaatggagcttcggtttccgcaataaacgtattttccggcttaccaccgccgggttgtaatgtgatataattaccagaaactaaagcatcaattccggagattcccgccaaagaagcactaggctgcactaaccaaaattttgtattttccttgaggatgctttttgcctccggataaatatttgctaatacttccacttttttgagatcatcagtgaaatttactttttttactacgccaatttgtaacccttgatagcgaatttgtgtttttccggcaactaaaccggctccattcacaaaagttatcttaatactttccccttgctctttaataatctgaaagaacaaaagtgtacagatacataatgcaataaagggcagtaaccaaaaaggcgatatacgtttggtttgtttaatttgggctttcaattcttccattgtttctatttgattatctaattttttgtttgtcataaatattccaaagtaaacgactatcaaattgtgaagtcgacatcattgttaaaaataccgttgctccgaaataaaatgcggcaggacctactgaaaaatcaataagttgccctcttgttactaatgacatcatcagagcaagtacaaataagtcaagcatggaccaacgtcctacgaaatgtacaaaatggagcaagcgtatttgcaggtgaatcgaatgttgccatttaaaatgaatggagaacaaaagataacacataattaaaatcttactgaaaggaataaaaatactggcaacaaatacaacaaatgctacaaagtagcttcctaaattgataaaggtcagaacgccggacattaatgtgtcttctgttgctataccgttcacataaactatcgacattggaagcaaattagcaggaataatcattacgaccgcagccaataaggttgcccaagttcgctgtaaatagacttcatctgaaaaatcaaggcgtgatagacaacgtgggcaaatggggcgtcgttttctatccgtatgacaatgattgaaagtatgttcacaatgcttgcacgcaataataggaagatttttttgttgtagcggagttttttggggataaaaatgccgccacaattcagcaggattgatttttataaataataatgtggtcaaaagtgcggtaaaaataaatgcaattaaatagctattaatatgtaggcttgcatattcttgtactttgaacatggttacgcccaaagcaactaaataaacatcaaacatcacccagggttttagataatttaacgttaacagtaagtgacgaggtctgatgtctaatagctgtgataaacgaagtaaaataactaataaagcaaagcttataggcataaataccgcacatagaaaaatcataaatgcagtgtaaggatagccttgaattgccattttccatataccttgccaaacagacgcatttactggcgtaccaagcaggttgatggttaataatgggtatcctaaggcaaacggcattaaaatcaaaatagtcaatgcgatgattgcacaacgtttcaaattccaactggaggtgttttgcagtactttgtgacaacgaggacaattcgctgattgatttttttgtaataagccaacagaaactaacgcattacaatcagtgcaacttataaggcagtatttagcttgtgataaattagtttttttctgcatgttgtcttattgatgaataataaagaaaggctattctaacctaatttttatcggaaatactatttttcattatagccataagagaaaagtgcggtcatttttagtgaaagtttcgtttcatttaagtattaattgtttatttttttttgttttaagctaaaatgtggcgagtttttttatctaaaaagtcattaagacaggaatatataacatgactgaaattcaaaaattaacaaataacaaagaaattattgcttacttagcagaaaagttcccattatgtttttcattggaaggtgaagcgaaaccattgaaaattggtttatttcaggatttggctgaagcgttagcaaacgatgaaaaagtgagtaaaactcaattacgccaagccttgcgtcaatatacttctaactggcgttatttacatggttgtcgtgccggtgcggtacgtgtggatttaaatggtgaacctgccggtattttagaacaagagcacgttgagcatgccgcagctaagttagcagaagctaaagcgaaagttgctgaaagacgtgcggttgaaaaagcaaataatccaaaagcaaataaaaaacgctctgtacatcgttcagcgaataagtcagaaaataagaaatcagctggaaagaaattctccaaaccccgtcaagttgaacaaatttttgtcaacgttgatttagcaaatttacaaaaaggagatgtggtgagagttaaagcgggagataaaactactaaggctgagatattagaagtggttaaagagggtgcccgtgttgaattagagaatggattgatattaactgtaagtgcggatcgtttatttgcgtaattttataatacatggctaatttagtacctcgtctcctctggtattattttcgtgtttaattattttaggaaagtgatctatgaaattacctcaacaactgcgttatttgctttgtttgctgtttggctttgttttaagtttaaattatgccgtcgcagttgaaccaaaactgaaactaacggatcttgttattccacagataacgcaagaaaatcaattagcaactaaaagaactgctgctcgtttggttcattcacattatcaagcagtagaactcaatgatgagttttctcagcggatttttgatcgttatttgaaagcacttgattttaatcgtaatacttttttgcaatctgatattgataatatgagagcaacgtatgcggataaaattgatgatgtgttaaatgagggaaaactagatattgcctttaatatgtatgagttattgatgaagcgtcgctatgagcgttatcgttatgctctatctttattggatgaagagcctgatttaaatggcaatgatcaaattgaaatagatcgggaaaaagcggattggccaaaaaatgaaactgaggcaaataagttatgggaacatcgagtcaaaaatgatgtgattaacttaaagttaaaaggtaaaaaatggcctgaaattcaaacgaggttagttaaacgttataatttagctattcagcatctaagtaaagtaaagtctgatgatattgtacaattgtatttgaatgcttttgcaagagagattgatccccataccagttatctggcacctcgcacagctaaaaatttcaatgaaaacatgaacttgtctcttgagggaataggtgcaactttacagtcagaagatggtgaaaccactataaaatcgcttgttcccggtgctccggcagatcgtagtaaaaagcttaaagccggtgataaaattattggagtcgggcaagcgacaggggaaattgaagatgtagtcggttggcgtattgatgatgttgttgataaaatcaaggggaagaaaggaacaaaagttcgtttagaaatagaaccagctaaaggtggaaaatctcaaattattacgttagtgcgagatcgtgttcgtttagaagatcaggctgctaaactaacagttgaaactgttgctggtaacaagatcgccgtgattaaaattccggggttttataatggcttaactgaggatgtacgtaaattacttgttgaagttgaagctaaaaaagcggaagctttaatcattgatttacgtggaaatggtggtggctctttaccggaagctattgagttaaccggtttatttattactgacggtcctgtggttcaagttcgggacgcacatcaacgtattcgtatatatgatgatcctgatacagagcaagtttattccggtcccttgcttgttatgattgaccgatttagtgcatccgcatcggagattttttcagctgcgatgcaagattataatcgagctattattcttgggcaaaatacttttggcaaaggaacggttcagcaaagtagatcactgaactttgtatatgattcaaatagtatggctcctttgggtttactgcaatatactattcaaaagttttatagaattaacggtggcagtactcaattaaaaggagtcgctccggatattatttttccctcctctattgatgatgaagaatatggggaagaaaaagaagataatgcgttaccttgggataaaattccatcagcgtcatattctgaagtcggtaatgcacgcctgccggtagatatattgaatcagaaacatcttgaacgtattgcgaaagaccctgagtttattgcactggatgaagatttaaagattcgtgatgaaagaaaagaacgtaagtttttatcgttgaactttactcaaagaaaagctgaaaatgataaagatgatgaaaaacgcttgaaagatcttaatgctcgtttcaaacgagaagggaaaaaaccactaaaagatcttgatgctttgccgaaagattatgaggatcctgatttttatttaaaagaagctctgaagattgcggtagatttaattgaatttaataaaaaaatggctgagtaaaataagatttaaaatatccgcacttttgaaaagtgcggtcttttttgttatctaaggaactaacatgcgaaaaattaaagttatcttattaatcttattattaggcactacgactcatatttatgcacaacaaaagtttacttctgtagatgagattaataacattactttaagtaaatcacaattattgtttgaattagatttattggaacaacaactatccgaggaatatcagcctagattatatgaacaattacattctttgctcagaaatatagatttacaatttaaaactacaattggtcgtatttatgttgaaaatgactatgcattgctttgggaagataagcaagccgaaaaaatgtttttacgtgaatatgccgcaatagttgcaagcggagtatctgaaagagcggcaagattattgaatgatatttataaagcatctgaaataggagggttagtttatgatatgttgctgaccgatgcatttttggattatatgtattattcaaaaaatgcaaaaaattttgcacaacagtggttttactcagcaaatagctacaaagctcaattaccatcaaaacaagatattcaacgatggctatcatcaataaaacataatgaaaatttgatgttcatcgaacaattagctcaacataatgagcaatatgagaaaattataactcacctgagtaaattaatacctcaagatgacaagtcaatattatacaaattagcaattaatgctcagcgtttaaggattattcctgattttaacaatggtatttttgttaatattccaagttatcaattaaattattatagagatggagaattagttttaaactctaaagtcattgtcggtaaaaaagcacgtaaaacaccggtaatgtatagtaagctaagtaatattgttgttaatccaccttggatacctactcctcgtttaattaatgaagatatcgtgccaaagattaaacttgatccggattatgttgctcgtaatagttataccataagtgatagcaaggggcaggttatagatccttcttcaatagattggaatactataggcactaattttccctatcgaatccgccaagctccgggaggaagtgcattaggaaactataaatttaatatgcccagttcagatgcaatttatttacacgatacacccaatagaggattatttagcaaaaaaaatagagcattaagttcaggttgtgttcgtgtagaaaagtcagatcaactggcgacaattttattaacagaagccggttggacagaagaacgtaagcaaaacgtgcttaatagtaaaaaaaatacttcggagaatattcgctccgataatcctgtatatttatattatgttactacttgggttgaaaacgatgtcgtgaaaacattacctgatatttatgagtatgatcaagtacctcatttaacttatattaactggaatattattaaatggtatctaaattaaaatgtgagcagcaagaactaaatgttatgtttgctgtcgaaagcaaatcatttagcactttataacgaaatattatatgaatgaaattaatcaaaatcgtcgcaaatggctatctttaggggggattattcttggtgcagccttgttacctcaaagtgttttagccgtattaccgaagccttctaaatctaaatttttatcttttagaaacatcaataccggagagagatttcgtggtgagttttttgccaataaaggtttttccagctctgatttgaaaaaaatagatcatttaatgcgagataaacgcaataatcaaattcataaaatggatcccaagttatttcataaatttgttcatattcaaaacaacttaggtttgcaaaattctgaaattcaaattatttgcgggtatcgttctccggcgagtaattccgccatgctacgtagtggtcgaggtgtcgcacgtaacagctatcatactcgtggacaagcaattgattttcgcattgagggggtttcattagcgaaacttcgtcaaacagcagaaaatttgaaaaatggcggtgttggttactatcctcgcagcaattttattcatgtggatacggggccagttcgtacttggcgaggtagctaaaatactaaacgtaatatagttgaccgcactttattcaaagtgcggttttattatttaaataaataaggaaatgatatgaatattgaaattgtgccggtaacggcatttcagcaaaattgttcaatcatttgggataataacaaaagtgcggctattattgatcccggtggtgaagcgacaaaattaattaaacgcattgaagaattaggcttaaatcttgaattgatcttactgacccatggacatattgatcatgtcggagccgcactgaagttaaaacaatattttaatgtagaaatttggggttctaatgaaaaagatgattttttatttaatagcttaccacaacaatctgagcaatttggcttactttttgagactgaggtatttaaacctgatagatggttaaatcaggagtatgaaattgtccgtattggggaaatgaattttgaagtattgcatcttccggggcatactcccggtcatgtcggttttatcgaatatagtaaaaaaattgcttttaccggagatgttttgttccaaaatagtatcggaagaacagactttccaagaggaaatcatgctgaattaattcaatctattcgtgacaagttatggaagttagatgatgatatgattattattgcaggacatggtaattatacaaccataggaaaagagaaaaaatacaatccttatatccgctaaaagttaagatgcaaattatgttattgatttacacttaaaggacaattcactagaatagtcaacatttattaatttatcttgaattctataaaggtagcaaaatgattgatccaactttattacgcaataatctttctgaaattgcggaaaaattaaaagtaagacgtggctttattctcgacgtaaataaattttcacaattagaagaacaacgtaagactttacaaattaaaacggaaactttacaagccgaacgtaactctcgctcaaaaacaattggtgcggcaaaagccagaggagaagatatttctactttattggcagaagttgatcatatgggagccgaattaaatactgtcaaagaagaattagcgaatgtattaacggaaattgagcaattggcattaacaattcccaatattcctgctgatgaagtacctttaggaaaagatgattctgataataaagaagtttttcgttggggaacaccaaaaaaatttgatttcgaagtgaaagatcatgttgccttaggggaaatattaggtgggctagattttgctgccggtgttaaattaagtggtgctcgttttgccgtaataaaagggcaaattgcaagaatgcatcgagccttggcacagtttatgctagatttacatactgagcaacatggctatacagaggcttatgtaccttatttagtcaatcatacaacactttatggaacggggcagttaccaaaatttggtgaggagttatttcatataaaacccctagaaaatgaacagacttatgcgttaatccctaccgccgaagtgcctgtaacaaacttagttcgagatgaaatcatcgatgaggctgatttaccaataaaaatgaccgcacatacgccttgtttccgttctgaagcaggttcttacggtcgtgatactcgaggtttaatccgtatgcatcaatttgataaggttgaattagtacaaattgttgaaccggaaaaatcaatggaagcactggaagaattgacaaatcaggcagaaaaagtattacaacttttaaatttaccttatcgtaaagttttattgtgtacaggcgacatgggattcggagctactaaaacatatgatttggaagtatggattccggcacaaaatacgtatcgtgagatttcttcttgctcaaatatgtgggatttccaagcacgtcgtatgcaagcccgttgtcgtgcaaaaggcgataaaaaaacacgcttagtacatactttaaatggatcgggactagctgttggtcgcactttagttgccattcttgaaaattatcaaaatgcagatggctctattaccgtaccggaagtattacgcccttatatgaatggaatagaaattattggtaaataatctgttgccgaaagataacaacgctccttttgggagcgttatctcatcaagccaaacctgtcataatcttactctcaaagaaatcataatctactaaaaaagcatcatgtccataatctgaaggaaattcataataatttaaatcaacgccgctttgctccaataatgctttacttttatgtagatcggtcaatttaaacaactgatcagtggtaactgcgaccaaagtatagcgtgcttttatacgacttaatgcagccttaatgtccttatagttccaagccggatcatataaatctaaagcccgcaataaatgcacatagctattggcatcaaaacgttccaaaaattttttcccttgataagttaaataagattcaacttggaaataatctccccaatacagactttccgcttttttagctcgtccaaacgctttttctaattgaaaatcggtacgataggtcagcatacccaacattctcgcaatagataaccctttacttggaggcagtctgtcataataatctccattattaaaatgaggatcattaataatcgcttgacgcatcacatgattaaacccgattgcctccgcacttaaataaagtgacgaacaaagattaaccactctgctaacgcaatcaggataatcaatagcccattgtgtcgcttgcattcccccgaacgagccaccaatcacagcataaagttttgctatatccaatgtattcagcagttctcgctgaactttcaccatatcttgtacaataatatgcggaaactgactaccgtaaggtttatttgtatcaggattaatggacgaaggacctgttgtccctttacagccacccaatacattagaacaaataaaaaaatatttactcgtatcaagtgccaatccctcccccataaaactctgccaccaaccattttgcgatttatcagcaaaatagggttcagcatcgccggtcaaagcatgacaaattaaaatgacattgctcttatctttatttaaagcaccataagtctgataagcaacttcaatattttttaattgcccaccttgtactaacatcaagggataatcggtaaaaagcgttaaagtttgtacagccatgtaaatttctcaaaaatcttaataaaaagcaccgcactttataaaagtaacccctgtaaactactcatactctgtttcattgtcaaggaatttttagccatctaaacatctggacagccaataaaatttacttgaaattacccgcttttttcattattttgtagcctccgaacgaggcagctataaaatgaacttagatttcacacaactttcttttccacaatggataataacgctcgtcaagcgattactacattacagctttgctttcagcatttttacatttttttcccttattatcattgatcgtagcatagcttggtatgttcaggacagaatttatacaaaaattgaagaacttccctaccgcccttatggtattgtgctaggcacagcgaaatactttagtaaaaataatcccaatctttattacaacaatcgcctgactgctactgttgagctttttaaacaagagaaaattgattatttattattgagtggtgataacagaacaatgcaatacaatgaacccataaccatgtttaaagatttgcgaaaaatggatattccggaagatgttatgtatatggattttgccggttttagaacgttagattccgtcattcgtgcagataaagtctttaaagcacagcccatgacaattattacccaacaatttcactgcgaacgggccttatttatcgcaaaattctacgatattgatgctatctgctttgcggcaaaatcacctactaactacttatctgtacgaatgagagaattatttgcaagagtaaaagcgattttagatattgtattagaaaaagagccttattttttgggaaatccagaaccgctcccaacgccaataactcaattatgatcttcgctaaataatctagcaagcttataaaaaagacaataaagttaaaaatcccatcaggcaacatattattttccaaccattttctaccgcacttttagcaaaacatttattaatcacgaacaagtaaaaattttaaggttttacacagacttatatttgtcaagattgaaaaaagaaaaaaaacagaaaaattttaaaaaaaacttctagacttaatgtaaccatttgaaaaataatgaaatgttattttacaaccaattttatatgaggatatggaaaccctagattttacaaggtttaagcgaaataaatcttgaataatttacagagttatccacaggttatgtggatagtaatttgcatgaaaaaatttttactataataaaaaaatcctgttgacaagcatacaccagatcattatcatacgcacctctccttatgagaccatatttatggtatttttcctccttagttcagtcggtagaacggcggactgttaatccgtatgtcgctggttcaagtccagcaggaggagccagttttttcttttgggttgtttttatttgtctccttttataaaaactcaatttaccaaaagactttaagcccatttagatcttctccttgtatgggcttttattttttcttttctatattcaaatttctcgaaatttattttatactcgctactttcacacttcatttatatctcgtttaggttcaaatatgttattccctatactcgctattatttcaggtttaattattttagtttggagtgctgatcgttttattgacggtgctgcatcgctggctcgtttcctcggtatgtccgcattattgatcggcattatcattgttggttttggaacatctgcccctgaaatgatcgtttctgccctttccgctttaaatggaaatcccgggcttgctttaggtaatgcttatggttcaaatattggtaatattgccctaattttaggtttaaccgccttaatcaaacctgttatagttaattcgctggttttaaaacaagaattacccattttaactttcgtcactttagtttctgcttacttaatttatgatgctgaaatttctcatttagatgcgattattttacttgttatttttgctatatacatggcttggagtatttggcaaagcaaaagatcagcacaagacagttttgccgaagatgtaacaacagaattggaagaaaaaaaaaccatatcagtaaaattagcagtattctggatgattacgggattgattttactaatgggaagctcacaattattggtgtggggagctgttcaaattgcttctcaattaggtgtgagtgatttagtgatcggtcttactattgtagcaattggcacttcattacctgagttagcagcctcaatcatggcggctcgtaaaggtgaagtagatcttgcggttggtaatattattggttctaatttatttaataccttagctgtcgttggcatagctggcttaatttccccaattcaagtgagcaatgaaatatttactcgagatatgttagttatggggggattaacgctctcactgttctttttcggctatggatctcgtcaaaaaaatggctcgattaatcgtattgaaggcggtttattgataacaagttatatcgtctatacttatttcctcattaccaccgcactttaaacaataaattaattgggagattaatttctcccaattaacaaagcacccccacgtatcggtaaagttgtgccatacattaaactcaaggcaaaaaatataatcatcagaccagcaagtatcctgactaggatatgccaaaacttcttatgtgttgaaaaataaaaatgccctaactgaaccgcacttttccgtgcatacaacacaattaatgcaaaacctgacagcattaatccaacacctaatgacatcgctacagtagccaacattccccaaacatacaaatccaacatatacgacaaaaataggataaatattgctccagaacaaggacgcattccaatagtgaaaataactaaacattgtgattttaaactctgtgcttgctgtaactgttgctgattgggtaaatgctgatgcccacaagaacaattatccgtatgctcatgaaatcttggcaaattttgtaccgcactttgcatacctattttattggtaggtattgaagagagtgtgaattgcttgatttttagcgactgactattttttttcaataaagacttgctcccttgccaaatccattgcaatcccaaaataatcatcaagagataagctccacgttctaaccaaagctgacttaatttaaaatagcttgaggataactgtaaaatagccacaacaattaatgtcagggaaatcgccacaataccttgcattaaagaagcacaaaaagttaatttcatactggtttttatctgggattgatgggttgctaaataactaccaataataaactttccatgccccggacctaacgcatggagaacaccataaataaaactcaccacaattaatcccattcctgcatagacaggggcttgttttacttgatgcaggtaacttgaaagtaattgattaaattctctctgccaaattaaaacgtgtgaaaataaatatgagaacagataaataccacctaacgataaaaatacaagcaataatataagtttataggttctttttattgacattggataactactttttgtgcaaatataacgcctaacgagctgtcttcatcacgttggttacgatctaaagaggcagcatattctcgtaatttttgatcaacttgaggttcgacaacatttccttgacaatgttgcggaagtgacgaaaaatctaccgcacttttctccttgtctttatcgtaatacatagatacatagtaggttgaatcataagtagataattcaaaacggttattggataactcctgaggtttagctaataaaaaatcaaaaaaatataaaacttgtgcaccgttagattttaatccatagttttgaggaattgcagaatacttaattttatttcctttcttatcatacaaataactaaaataatgttcattaacaacattttggatcatatcatcaataaatttttgtaattctttttgatcatcttgcaaaaaagccaaatcatataaaacagcagatgaacttgattcatctaaaatccattgcatagaaaaaccaactaatttttgcttgtcaataatgggttttgtctgcatttcaataaaagcgtgtgggtgagctaaactgtatataggcaaaaagccaagaataatcccgaataaacgaatgaattgttgcatattcttccaatcaaataactaagtacgcattatgctatcacaatatagcgttgatttttatcttttcaaaaaaatcatgagaagttgagtttgcggaaattaagccccctaaagaacagagttttacggcaccgtcagataaaaaacttacggattatcacacataaagctaacaaaaatcaataaaagtgcggtacaattcgcaagtttttcacttttaaaacgtggcttatgaactatcaaacatacattcctgatgaatatactatgtgtcaatttggtaaaaagttgatacatagtattgctcaaatcaaaagtaacaaaggaataaccctttatttacaaggtgatttaggagcaggaaaaactacgttaagtcggggaatgatccaaggtatagggcataccggtaatgttaaaagccctacttataccttagttgaagaatatcatcttgatgaaaaagatatttatcatttcgatctttaccgccttagtgatcctgaagaattggaatttatgggcattcgagattactttaatgaaagatccatttgcttaatcgaatgggcagaaaaagggcaaggcatattacctgagcctgatttaatcgttcatatcaattactttgatgatgcacgtagtattgaattacactctatatcagaacaaggccatttaattattcaacaattagtttaaaccatgaattacttacaacgcttgattttcattattttagcgattttcgcctttaatcatgcttttgctcacgtttggacaattgccatcgatcccggacatgggggaaaagaccccggtgctattggacgtcgtctcaatatctatgaaaaaaatgttaccctttccattgctcgtgaactaaagaaattgttagataaagatcctcactttcgtgccgtactcacacgagaaggcgattattatatttcagtctctaaacgctcggaaatcgcacgtaaacataaggcaaattatctcatctccattcatgccgattcatctgaatcaagtttgttacgtggtgcatcggtttgggttttatccaatcgccgagccaatagcgaaatgggacaatggctggaagatcatgaaaaacgttccgaattgttaggcggtgcaggtgatgtcttagcttcacataaagaaaaatatctagataaaactgtattggatctgcaatttggacatagccagcgtgttagttatgaacttggttcagttgttttacgtcactttgctcgtatcgcaaaattaagtcgtagcacaccgcaacatgccagtttaggcgttttacgttcccctgatattccgtctattttggttgaaacaggttttctttccaatgcggaagaagaaaaaaaattaaatacccttgcctaccgtaaaaaattggcaaaagttatttatgatagtttagtagaatatcgcaaacgcaatttaaaagtagatctcaataccacaaaaaatacccgccaaactaaaccaaaaaccaacagtgcggtagataatacaaacaaaacacccgttaaagacagcggtattcgtcataaagtaaaagcaggcgaaggattaacgagattagcaagaatctataaagtgaatattaaagatattatcagtttaaataaactcaatcgtaatcaactttggcttggtgaaataataaaaattcctgctaacaatgaaaatacaccaaaagagaaagagaaagcgaaagagaaaaagaaagctaaagataaaaatgcaacattccatatagtgaaaaaaaatcaaacactctatgcaatttcacgtcaatacaacattcctgtgaaaactttgctcaaactcaatcccaaactaaaagatggcaaagtacaaatagggcaaaaaattaaattacgtgaataagggctaagcaaacgtatgacaattaaaattcttcctccacaactggctaaccaaatagcggcgggcgaagtggtagagcgtccggcttctgtcgtcaaagaactgattgaaaacagcttggatgcaggagcgacacacattcaaattgagattgaaaatggcggtgcaaatttaattcgtattcgtgacaacggcataggaattgcaaaagatgaactccatttagcccttgctcgccacgcaacaagcaaaatcgccagccttgatgatcttgaaatgattttaagtttaggctttcgtggcgaagcacttgcaagtatcagttcagtttcccgtttaaccttaacctctcgtacagcacaacaaaatgaagcatggcaagtttatgcacaaggtcgagatatggaaaccagcatcacacccgcttctcatccgattggcacaacagttgaagtagcaaatttgttttttaatacgcctgccagacgcaaatttttacgtacagacaaaactgaatttgcacatattgatgaagtaatccgccgtatagcgttggcaaaacctcaagttgcttttacgttgacccataacaataaattaatacaccgctataaaagtgcggtaacaaatgagcaaaaaattaagcgtattgcgactatttgtggcaatgattttatgcaaaatgcgttacatattgattggaaacataatgatctgcatctttccggttgggttatacaacctcagtttgctcgtcatcaaaatgacctcaattattgttatatcaatggcagaatggtgcgagataaagtcattacgcatgctatccgtcaagcctattcagaataccttaacaacgaacaatatccggcatttgtattatttattgatctcaatccgaatgaagtagatgtaaacgtacacccaaccaaacatgaagttcgctttcatcaagctcgtctaattcacgattttatttatcaaggaattatgaatgcgttaacctctgagcaaaccaatagtccaacacatagtgaacaatctaacccaatcaaagttgccgaacctcaaggtatttggaacttgaccacgcataacaaaggtaatcgagcgactgccggcaaaaatatttttgcccagcaacctaaagattatgataaaaaatcgtctcaatttaaaccgcactttgcagcaaattacagcgaagtaacgccaaagaaagcagtgcaaaaagcctatgcagaattactcgcaacacatgaagaaaaaactatcgcctcttctactctaccccatcaatttacacacaatgcaacgcatatcagtgaacagaaaaatgttttacatgcacttgcattaattgaaaataaggcattgttattgcaacaaaaccaacaatatttcctcctttctattcaggcattgcagcatttcaatatccgcttacagttgcaacaaagtaatattgcacaacaaacattgcttattccgattttattgcgtttaaataaacaacaatatcaatcttggcaacagcaagctctattttttcaacaaagcggtttcgattttacagaaaattctgcgcaacacagaataactctaaaccgtttacctatttgcttgcgtacacaaaatatacaaaaaataattttacagttattggatcaacctcatgaaaaatacactatttttcttaccgcactttgctcacaattggaatttccctcgctcagtactttctccgaagctgtaaatttactcacaaaaactgagcaacaattttcaccccaacatcaaccagaattccaatctttattagtcaaaatagagtgggatcactatttagataaattgcaatgaataaaaaatcaactgctatctttttaatggggccaaccgcttccggcaaaaccgacctcgctatccaattacatcaagaacttcctgttgaagtcatcagtgtcgattcagctttaatttataaaggcatggacattggtacagcaaaacccaatgcacaagaattagcactaacacctcatcgtctaattgatattaaagatccaagtgaaaattattctgctgcagaatttcgtcatgacgcattacaagaaatgaaaaaaatcacgcaacaaggaaaaattccacttcttgttggcggtacaatgttgtattacaaagccttattggaaggactttcgccgcttccttcagcggatgaaaaagtgcggttggaaatagaacaaaaagcagaaaaatttggttgggcaacactacacaacgaattagccaaaatcgacccaatctcggcacaacgtataaatcccaacgacagccagcgaattaatcgtgcattggaggtcttctatttaacaggacaatctttaacggaattaaccgcacaaaaaggcgaagaaattccttatcacatcatacaatttgctatcgcaccagaacgagctgttttacaccaacgcattgaacaacgttttcataaaatgatcgaacaaggctttcaacaggaagtcgaaaaactttatcaacgctcggatctacaccctaacctaccctctattcgttgtgtcggttatcgacaaatgtgggaatatttacagggtaattatggtaaagacgaaatgatatttaggggtatttgtgccacaagacaattagcaaaacgacaacttacttggttgcgtggttggaaatcgcccatagaatggctagacagcctaaaccccaaaagcacgaaagaaaaaatcataaaaactataaaacataactgtaaataaagttcacaaaatcgtttttttctataaaaatttaggataaaatggctcgaatttttacttgacaaataaaatagaacggaaaaaatgacagcctacagcctacagcctacagcctacagcctacagcctacagcctacagcctacagcctacagcctacagcctacagcctacagcctacagcctacagcctacagcctnnnnnnnnnnnnnnnnnnnnnnnnnnnnnnnnnnnnnnnnnnnnnnnnnnnnnnnnnnnncctacagcctacagcctacagcctacagcctacagcctacagcctacagcctacagcctacagcctacagcctacagcctacagcctacagcctacagcctacagcctacagcctacagcctacagcctacagcctacagcctacagcctacagcctagtatattggctaaaatcaacctttcaagttaawtttgagaggttggacatgttcaaacaatatcttaaaaatcacctatttcaacctcaacctttcggcgaaagtattattcgcctttttttgttgtgtcttaaaaagcaaggcatcgccgatttatttatcaatctatctaaaaagcaaagcgtttaatcaataaacaaccgtaaaaaagttaaaaaaatcaacaaaataaatcaataaaaaaacctaattttaaaagcttaaagagagtgaatttatgaacaaaatcttcaaaaccaaatacgatgtaacaactggacaaaccaaagtggtgtctgaattagcgaataaccgccaagtggcgagccgtgttgaggcgacggggcgtcagccgaagtgcggtgtgtttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggcctgaggatgaaaaatataggaagggtgaaaaagaattagaaatgtcggctattgcgataggaactagtgcaatagctaacgctcaaaatagtgtagcactcggaaatgaagctcaagtaagcatggaaaattcggtggcattagggaataaatcacatacaaaatatttctatcaagatgataataacaaaaacactgccacgctcagcggaaacggcaaaaatgatgcgattaatttagccccttatattccagagggttctagctataacttaaaaaccgatacagcggcgggtattgtgtcsgtmggttggacaaaagataaaagcaaaacacaagaactgggcttaagacggattgtcggggtrgcaccgggtgcgttggactctgacgtggcgacgattggacaattaaaagccttagaatatgtaaaaagagaaggcttagtcgtttattatacggaagataatggaaaaatatataaattagttaaaggaacagatggaaaattctacaaggtcaataccaaaaatggcacaccattagataaacaagaaattccaaaagaaaaagtattagttggggctaaagggcataacgagaagatacaatacatagatgctgataaacaaattgcggacataggagaaaagataagattcgggcatttagccgatggmgagatttccaacaaatccgatcaggcgattactggggcacaacttkatgatcttaaaggtaagttggggttggaattagagaccaataatacacaattcaaaggacataattttacagcagttgaatatattgatggaamasaaggwwmrcaaaatacttttaaaggtgcaataacggaactgattaaagcygtcaataaaggttataagttcagtgatggaacgaaaactattgataagatttatttkggctcaacgattgaaataaaaccaraagatatttctaataatggtactcaatataagagtaaaaatttaaaaacaraagttgaaaaaaacagttcaaaggcaywattcaccatcggcttaaaagacgatccagaatttaatactgtaaaacttaccggcacccctacagataacaagcacgctgtcaataaggcatacgtggatgaaaaactcaaagacgtggcttcaaatatccactttatgtcagtacatacaccgaccacaacaccaaaaacaaaaggcaactatagcaacgacggwgcaaaagytgasggkgcgatygckatyggygtggacgcaagtgccgcttctgaaaactccatcgctatgggtaaarrytcraarattgakgmgrmaatatcgaacgccgtcgctatcggggcgaataatmacctyagagggaagaataaaggtcaagatacgaatackgtkgctattggttcaracaatatcatcacsggacgaaaagtygtgaatttaggttcggggaatargataggtaatactraagacrgttatcaamskgacccaaaagcagrtgcggtcagyrtacgaktratyggggacgataatawsgttsatggggtatggaataccgtcatcggtgaarrraatacatttacagattcctcagtctatgttcatttgatgggtgataaaaataccgtcacagattccaaaaataccatcatattaggcgataaaaatactgtctcaaaattagaaaactctatcatcattggtaaaaacataactgctaaatctaatgttaaaaacaataataatttaatcgtcatgggtaaccaagcccaagcaacaaatgcgaataacagtgtggtgatcggagcgtctgcaaaatctacagcggtaagtgcggtcgtgattggacaaaatgccgaatccaaagcccaaagtgcggtagttttaggtaaaggggcgactgttcaagccaacgccaccagtgcagtagcgattggtgaaggggcgtctgtatctacaaatgctggcgaatcaatagctttagggaaaggatcgcaagcgacggctaaagcgaatgcaatggcaaatgctactgtagagggcgtgaaatttgcctttgcaggtgggactggaaatagtaagacagtattaagcataggtaaagctggaacagagcgtgtcattaaacacgtggcagcgggcgaagtgagcaaaacctcaacagatgctattaacggaagtcaattgttcagtgtgacaacgggatttgcaaaattggcaaaagatgtcctcggggcggagttaagcacaactaatcaatttaaaaagtcagagtttaaagcattaaaagccacgagttcgtctgcggataccgcacaagcaaaaacatttagagaagcgattaatgcaaatatagaccaaattaataaaggcttggtatttagcgacggcacaacgcatggcacaagacagctgggcgaaacgatcaccatacaagccggcaatattgacggcggtgatttcgccagcgataacatcaaaacgaattacggtaaggatcaaggagtattcctaattggaattaaaaaagatccacgttttgaaaaagtcacagtaactaaagatgttgaagacggaagtcctgaaatgaccttaaccacgaaaaaatatgtggacagaaaacttgccaatgtcgccgctaaatttaccgtcaagggcgatactaacggaatagacggcaaagggtatgaattaaacaaagacaatacggaattgaatattaagggagatgataaaaacatcaccacagcagtggataaagacgctaaaaaattaaccgtatcgcttaagagtgctttaaccggcattacctcgattggaaaagataccaataatcaaatcgcctttaatagcgggacaacccttaaagccggcggtgcgagcttaacgttggcgaatgagggtggcaaagttaaattatcaaacgtagcaaatggtacggcggataatgacgcagtgaataaaagccaattggatcaaaaacaagataaattgacaggtactatcaccgcaaataatgggctaaaagtgacatcgggcgatgcgacaaatagcgttgcgaagagtatcacgttaagtttagaagatggcttaaaagacaaaatcgacaatgccttaagtaaaaccgaagcagggaatacctatgcgaaagtggatgcgtcgaatataaacaatggcaatcaaacagcatggagaaataaactaaatgtatattctaaagaagaaacaaatagtgaaatcgccaaagcgaaagaaacggtaacaaatggagatggaattactgttacagcaacagctgcaggagatggacctaaaacatttaaggttgcattagaagatagttacaaaacaaaaattgataatataggtaccggaactgtcacagctaataatgataaaaccgtaacgggtggtgttgtatataatgctattgaagaggcaaaaactgatataaaaagcaaactttattcaaacacggcaacatttgggctaaaaggtaatgatagccaagaagtgaccaaaaaattaaataacagtatcgaaatcaaaggcactggcacggctagaactagcggcacaaatatctatgtctcgaaagccgatgacaacggtctaaaaatcgaactgggtgaaaccttaaaaggtattacgtcgattactaagggcgataataagtctaaaatcgaatttaaagatgacagtatcgatttaacgccagttgatggtaaaactgtcactatcactaaagagggtaaaatcagcggcttgacagatggtcaaattgagaacgcctcaaaagacgtggtcacaggaaatcaattgcatgatctagcgggtaaattaggcgttagtgtggataaaaattctaaaaccggttttaccgcaccgttgtttgtcgccgtcaattatcaagggcaaacagcaactaacggaaaaactacctttaaagaagcaatcgatgatttgatcgtggctgtgaataaagggcttgtcattggcgacggtactgcaactggcacgcttcaactgggcgataccttgcagattaaagcggggaatatcgataaaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgaaagaatatgtggatgcgaaattagccactaaagcagggacatttaaagtgagttcggataaaggtgacacaaacaatatcaccggcactttatctgtcaaaggtaaagaagatgatgctaatggcaaacatcaaaatattaaaacagaagcgacaggatcgaatttaacgatagcacttaatagcgacttaaaaggcatatcgactattggaaaagatgataaggctaagattagctttaataaagatactgctaaaaatgagatcgagtttagtttgggagataacacgaaatataaattcgatgagaatggmttagayttaggargyaaaaaaatcaccgcacttgcgagcggtttagggttgaaagatgctgatactggaaacggaaatgccgacattattramaamgtcctcgmgggaactcttgataatggcagtaacrttaaatccactaacgccgtcaatgtraaagacctktmcraagtsgcsraagcccttgtggaaaaaggactwtcmtttgaggggaatgatggaagtagtaataaagttactcgcaaactcggygagacgttgaaaattgtgggyaaaggaagtggtgctaactcaataacaaccactgaaaataatattaaagtgtctaaaaatacagcaaacgatggactggaaattggcttgtctgataytttaayaggtattaaatctgttgstaatggcgataatgcgaaaattactttaagcggaagtaatrgaagcaaggacaaaattaccttcaaagcaggtagttcagaggttaccctagccgatggtaaatttagcggtgtttctgaaattaataaagaagcggataaaggagcgttgaaactnnnnnnnnnnnnnnnnnnnnnnnnnnnnnnnnnnnnnnnnnnnnnnnnnnnnnnnnnnnnnnnnnnnnnnnnnnnnnnnnnnnaagaggataaaggagcgttraaactcactgaaaacactgccactttagaaagtgcsaaagacggttcaaacctggcattggataataccagtgcmacsttaagtgcgggyaaagataarggmagtattaaagtyrycaatrrcrsrrmgaasaaaatcgagttaagtcckgaaaacggctcaacngttacgttganaaaagacatgacaaatggcggagtgcaagccaccggcttgtctaccatcggtaaagatgagaataaygctttagtgtttaaaaatggywcgagtggcacgaacacggcagagttaaaagtgggcggtgcrrykttaacattyacsyctastggaaatggaaytggcggaactnancaaacagtgaaaatctctaatgtkgcgrytggtaatatagcgactgattcaaaagatgccatcaccggcrgacaacttgmygatttagcargtaaattrggggttgaggttgatagtggtaaaactgcgtttacagcaccatcatttaatccgataaaaggtggtactaaagacactaatagtggcacgactgcggctgccccaacaacctttaaagatgctattactcagttaatcaccgctgtgaatggcggcttgacctttacaggaaatgatacttcccaaagtaaaaccacattacaattaggtggaacattgaccattgatagttcgagtgctggtagtgaaaaagayattacagcaaaactggaaccgtctaatggtagtgatcctaaagataacggtaaattaacgctgacgttaaataaagctacttctgtagataaaaatgacgaaaaagtcattacctcwaaagcsgtagcracwgmgytgraaaamtatacgraaacwkckrawttaggtratacgtatttgaaaatagacgggtcgaatattggtggtgcttcaggtaaacaaaaatttggtagcaatgtcggtattgctgaaatcaaacttggcgaaactgacaagagcgacactgaattggtacaagctaaagctttaatcagctatctaaaaggtacaggtcaaaaatccgttaaagtatccgataatccggaaactaaggctgaaggggactattctattgcgattggcgataaagcagtggcaaaaaatgaaagtgcaattgctatcggytatggtgctaaygcyaaaaatagaaackcacttgccwtaggyagagatagtgakgtattrggcgagcatgctacggctattggttwcmaaaataawgtatcgggcaatcattccggtgcattcgggaaacaaaacacggttarmggaragcattcctatgctgtgggtgcttataatacgctaggcggcgaacacacttatgtcttgggttcaagtgtcacgacagatgacaaggtaaaaaatgctgttatcttaggtaatcaatcaacaggtgtatctgatgccgtgtctgtgggtagtgatacgcaacaaagacgaattgtttatgtcgccgatccaaaaaatcaatacgatgcggtgaataaacaatatgtcgatgcacttggattaaaattcaaaggtaatgatgataaaaatatacacagaaaattatcagaaacattagaaatagttggtaagggattaaataaaaaccaaactactaaatttaatggcacaaatggaaatattgccgttaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggagaagatggagaaagaaaagatttagactatttaatagaaaatgttgataaatcatcgattaaaactcatgcagtcaatgttggagatttagcgaaaatttctaaggaaatagttgaaaaaggatataagtataaagctgatattccgtcaaataatagcaatgataccagcataaaactaggctcaaccatatctattgttaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacgccaaaatcgaaatcgggtttaaagacgcaccgaaatttagcaaagtgacnnnnnnnnnnnnnnnnnnnnnnnnnnnnnnnnnnnnnnnnnnnnnnnnnnnnnnnnnnnnnnnnntgatcaccaaatcctaccttgatgccgcattaaaagactttaagtttaatgtggaatatggtgrtmagaaagtccaaatcggtcgtggcgatacgttgaagtttaatgctgggctgaatattaaagtagagttagctcaaaatggtactacacaaccaagtgcggttggttctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaatggtgcaggtacaaatggcggaaatagtacaagcagtacagcttcgtcaggagctactccaagtacgacaacagctggcacagcaagcagtacaacatcgaacacyacwgcggtggtgacgattggtacgactgaggacttgacaggyttgaaatctgccgagtttaacggcgataacggtaacacgactcacattaccggcaatgaaattgtgttgaaagatcaggcaggtaacgctcatacacaaacggcgacatcgcaaatcatcacggataatacagatcccgataaggaaaaagcggtggtgacaacggctgagggcgtgacaatgtctgtggtcagcgatgatcaggttttggtcaatgatcaaacagcagaagcgaatgttttaagcaatggcaagcacacgacagaagtgaaagcaggtgaaattgctattaaggataaagtgggtcaagatgtcgtgagcttgaaagtggcagagggtgaaaacggtcaagatggcaagggagctacgcttgcgtttgctaaaggcactgacggtaaatcgggcactggcgtaatcatgggcttgaaagacctagatgccacggctgacggttcaagtgcggcgaataaaaactatgtggatgaaaaagtgtccgacttagatagcaatcgtccgtttgacttctatatccaagagggcgatgactataccaaagttgtcaaaggacgtgatggtaagttctatgatcctaaagatttagagggggcgaagtatgatgcagaaagtaaaaaatacattgctcaagatgggcaagatgtgacaccagagtcggataaggtgattattcgtgccgagccgactaccgcacctatcgggatgaataacgtggcgagtggtttgggactggcagatcctgaaactgatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgagtgccatgcctgagggtgaggataaaaagaaacttcaaactcaattggaggaaaacaagaaacagcttgaaaaagctaaagaagagctagggaaagcaaaaactgctttaaccgaggctcagacagaattaacagaagccaatgaagcttacgagaaaaactacgagggttatgaaaaagttgctgacttagtgaaacctgatagccaagcggatttaaccaacgtagccaccattgctgacgtgcaagcggtagcgaaatcgggcatgaagttcaagggcaatgatggtatggaggttcgtacgccattaagcgaaaccttagcaattaaaggtgaagaaaatgcaagtgacgagaagtttaacagcracmwcacygctgccggcaatatcaargtggaaatggcacaagatggcaaaggcttagaagttaaaytgtctgaccagttgaaaaacatgacwtcctttgaracwcgtgaagtgaacggtaagaaagcccgcttggatagcaacggtttacaagcgagcagtccagacagcgaaacttttgtaaatgcacagggtacccgtattgcgggcaaaggaaatcatgccggtcaatcggcaagttacaccctcgatggcgtggcgatcacaggtaagaacggaagcgtgcagttgaatacgaccgctctttcctttgcaaccactcgagaccaagctggtaaacctgtcggtacaggggttatccgaggtctgaaagacttggatgcccatgctaccggtgatatggcggcaaataaaaactatgtggacgaaaaagtgggtgctgccgttaatcgcctagataatgtcatcagtaccaacaaccgaaccttacaggcgggtattgccggtgcgaatgcggcggcagcattgcctacagtaacgatgccgggtaaatcgaccattgcgttgtccgcagggacttacaaaggcagaaatgcggtagcgataggctattcacgtctaagcgataatggtaagataacgctgaaattacagggcaacagcaactctgccggtgatttcggcggtggcgtgggtgttggttggacatggtagtctagtttaaccgctataaaaaagcagtgagtaatcactgctttttttatgataaaagtttcaccgctctttttagtttttgacgttcgacaaaatcgaaaagaaaatcctgttaaattaattacccttgataatgtccgacgcctagctcgtcttctttacgagtgcggttaataacgacttgcggagattgaacaatacgtaaccccatttcatcttcggtacgaactacctcacctcgcagagaattggtatagacatcagtaattttaatatctacaaacttaccgatcatgttaggcgttcctgcaaaattaactatacgatttgtttccgtacgacctgttaattccataatatcttttttcgatggaccttcaaccaatacacgttgctctgtccctaacattgctcgactaaattgtgctgcttgattgttaatgcgttgttgtagcaaatataggcgttgttttttctcttcttccgttacatcatcaggcatatctgctgccggcgttccgggacgagcagaataaataaagctaaagctcatatcaaaattcacttgagcaattaaattcatcgtgtcttcaaaatcctgatccgtttcccctggaaacccaacaataaaatctgaactaatctgaatattcggccgcactttttttaatttgcgaataattgatttatattcaagtgcggtatgatttcgcttcattaaattcagtacacgatctgaaccgctttgcacaggtaaatgtaagaaactcaccaattcaggcgtatccgcatatacatcaataatatcatcagtaaattcaattgggtggctggtggtaaaacgtaatcgatcaattccatcaatagaagcgactaaacgtaataactcagcaaatgaacaaataccgccatcatgtgttggtccacgataagcgttcacattctgccccaataaattgacttcacgcaccccttgctctgcaagttgtgcaatttcgaataagacatcatctacgggacgacttacctcttcacctcgagtataaggcactacacagaatgaacaatatttattacagccctccatgatagaaacgaacgctgtcggtccttccgctctcggttccggtaggcgatcaaatttctcaatttcaggaaaacttacatcaaccaccgcactttttccaccacgaatttgattaatcatttcaggtaggcgatgcaatgtttgtggcccaaatacaatatcaacataaggtgcacgtgaacgaatatgctccccttcctgtgaagccacacaaccgcccacaccaattaccaagctcggattttgtttctttaattctttccaacgacctaactgatgaaacactttttcttgtgctttttcacgaatagaacaggtatttaatagcaatacgtctgcttcttccggtacatcagtcagttctaaaccatgggtatttaaaagcaaatctgccattttcgaactatcatattcgttcatttggcagccccaagttttaatatgtaatttttgtgtcatgtcagtatttaaaattaatatctaagtaaaaaatcagtcggtcattttaccgagttgttgtagctgttgccagctaaaaatcagattttattttttaaatttaaccaataacgctaaaatagcgaaaattagtctgtggagaaaacacgtatgcaaaaagatattattgttgttggtggcggtatgattggtgcggcttgtgcgacaggattagctcaattgggattacaaatccacgtcattgaacatcattctctacctgaatttgattcgacatcggagtatgacattcgcatttctgcaattagtgctgcatcagttaatttattgaaaaccctaaaggcatggcagcatatcgaaaaaatgcgtattttcccttatcgaggactggaaacttgggaaattgaaggttttgcaacccaatttcactgccaagatttacagttagcggaacttggatttatggtagaaaataatcttattcaactaggattatggcagacattttcttcctaccataatattactaccaacgtggaaaatgcgattaaaaatgttgaaaagtgcggtaaaaattggcgtatttttttatccaatggagaaagttatcaagcacctctcatcattgcagctgacggtgccaattcacaattacgccaaattgcaggcataggtttgacaggctggcaatatcgacaagattgcatgctcattttagtgaatgtagaacaagatcaacaacatattacttggcaacaattttatccctccggacctagagccttgttaccattacaaaataagcaagcctgtttagtttggtatgacagcccacaaaaaatacgtgaattaaaacagctgtcaaatgaaaaacttgcagaagaaattcatcaagcatttccccctagactgggcaaaataaacgtacaaaaatttgcgacttttgcactaacacgtcgtcatgcacaagattatttcaaacaaggtattgttttagttggcgatgccgctcacacgattaatcctcttgccggacaaggtgtcaatttaggttttaaagacgtcaaagtcctgcttagtgtaattgaaagtgcggtaaaaaataatgaagatttttcaacggatcatgttttacaacgttatcaaaaccgacggaagcctgataatttactgatgcaatcgggtatggatttgttttataaagcctttaaagaagatagcatgccattaaaaatagctcgtaacttggcattactgggtgcaaacaaaatcacgcctcttaaaaaacaagcgttgaaatacgcacttggtttgtaaaaaatcacctaaaaatgaaatcatcactttcaattatgagctaatcgctatatcattagccattcaaaactaagggcgcttgcaattttattgtgggctttttatttctactcaatacctgaacaaacgcaggttcattagggagaaaaccaaagctagtggaaaatacagttcaaaacaagcctattattgagcttcgttctcttactaagtcttatgatacaaaaaccattatcaataacttcaatttaactattaataacggtgaatttttaacaattctaggtccgtcaggttgcggtaaaacaacagtgttacgtttgattgccggctttgaagagttaaatgaaggtcgtattattcttgatggtgaagatgtgacggatataccggcagagcgtcgtcacataaacaccgtattccaaagttatgccctgttcccacatatgacgatttttgaaaatgtggcctttggtttacgcatgcaaaaagtaccgaatgcagacattaaacctcgtgtaatggaagcattacgcatggtgcgtctagaagaaatggcggatcgtaagccaactcagctttccggcggtcaacaacaacgtgtcgccattgcaagagcggtagtaaataaacctaaagttttattgcttgatgaatctttatccgctcttgattataaattacgtaaagaaatgcaaaatgagttgaaagcattgcaacgtcagttgggaattacctttattttcgttactcacgatcaggaagaggcattaactatgtcagatcgtattatcgtaatgaacaaaggcactatccaacaagatggttcaccacgtgatatttacgaggatcctaaaaatctatttgtggcaaaatttatcggtgaaatcaatatttttgatgcgataattattgagcgtacagacgaaaaaactgttaaagccaatgtagaaggtcgtgtttgcgatattcatacagagttgactgtccaaccaaatcagaaattaaaaatcttgttacgtccggaagatattataattgaagaacttgatgaaaatgaaagttccaaagcaattattggacatgttgttgatcgtagctataaaggcatgacattagaatcaagcatcattcttgatcataataaaatgaaagtattggtgagtgaattctttaatgaagatgatccgcatatcgatcattcagtgggtcaaaaagtggcactaacgtggcatgaaggctgggaggttgtactggacgatgaagatgaacagtaataaatttcaaaacttaactgttagtgtcattttcggctggttactcttctttgttttagtaccaaacctgctagtcttaacagttagttttttatcaaaagatagcagtaatttttatgctttgccttttagcttggaaagttacgcaaacttagttgactcacattacgccaaagtaatgtggaattcactccgtatgtctgcgattgcaactgttatctgtttacttgtaggttatccttttgcattttttattgccaaaataaaaccctcataccgtccatttttgctattcctcgttgttttacctttttggacgaattcgttaattcgtatttacggaatgaaaatctttcttggtatgaaaggtattttaaacaataccctaattgcaatcggtattattgacacaccaattcgtatcttgaataccgaaactgcggtaatcattggattagtttacatcttactgccttttatgattttaccgctttacgctgctattgaaaaactggatcttcgtttattagaagcggcaaaagatttgggagcgaattcattccaacgttttattagaatcattattccattaacaatgccgggaattatcgcaggttgtttgttagttctattacccgcaatgggaatgttctatgtgtcagatttgcttggcggtgcgaaagcagccctagtaggtaatgaaatttatgtccaattcttaaaaataagaaactggcctatgggttcagcaattagtatagcacttactctactaatggctttattaatttttatttactataaaacaagtaaattattaaataaaaaaatggagttggaataatgagtcgtttactacgtaatatctttttgtttgtggtatacgcttatctgtatatcccgattattattctaatcagtaattcatttaacaatgatcgtttcggtaatacttggaaaggtttcggttttcaatggtatgagcgtttattcaacaacgatactctcattcaagccgctattcattccatcactattgcattttttgcagcctcattagcaacaattattggaacattaactgctatcgcactttatcgttatcgcttccgtggtaaacaggctataagcggaatgctgtttattgtgatgatgtcgcctgatattgttatggctgtctccctacttgcattgtttatgatagtaggtatctctttaggattttggtcattacttttagctcacgtaacattctgtttgccttatgttgtagtcagtgttttctctcgtctaaaaggttttgataacaaaatgttggaagcggcaaaagatttaggtgccggtgaagtaacaatattacgcaagatcattttaccgttagcgttgcctgccattgtttcaggttggctacttagctttaccatttcattagatgatgtagttgtgtcctcatttgtcagtggtgtaagttatgaaattttaccattaaagattttctccttagtgaaaaccggggtaacccctgaagtcaatgcactggcaacactgatgattattttctctttaatattggtaatactcagtcaacttgttgccaaaaaagggaaataataatattccaaaactgtgaaataatatttcacaaatgatcctatatcacataaaataacacgccctactttcggtaaggcgtttttattccttcaacaccgaagtatattccgcatgttaaaagtgcggtcgttttttactcttatattggagaacaatagaaatgaaaaaattttcaggtcttttcacactgggaatgatcgctgtagctctagcggcttgtaatgataaagatactcaaaaagcagagactcaagcacctgctgcttctgcaggtgatactgtttatctttatacttggacagaatatgttcctgatggattattagaaggcttcactcaagaaacaggcattaaagtcaaccgttcaagtctagaatctaacgaaacaatgtatgcaaaaattaaaactcaaggtgctgccggcggttatgatgttattgctccatcaaactactttgtttcaaaaatggctcgtgaaggtatgctaatggaattagaccacagcaaattacctgtcatcaaagaattaaacccagattggttagacaaaccttacgataaaggtaacaaatactctttacctcaattgttaggagcaccgggcattgcatttaatacaaatgaatataaaggctctgacttcacatcgtgggctgatttatggaaacctgaatttgccggtaaagttcaattattggatgacgcacgagaagtattcaatatcgcattgttaaaattaggacaggatccaaatacacaagatcctaaaattatcgaacaagcgtatgaagagttattaaaattacgtccaaacgtactatctttcaactcagataacccggctaattcttttatttcaggggaagtgagtattggtcaattatggaacggttctgtacgtatcgctaaaaaagaaaaagcacctttagatatggtattcccgaaagaggggcctgttctttgggttgatacgttagccattccatcaacatctaaaaatccggatgctgcacataagttaattaactacatgctaggtgcaaaaacagcagcacaactcaccttggaaattggttatccaacctctaatatcaaggcattagaattacttccggctgaaattactcaagatccggcaatctaccctacagctgaagttttacaaaacagttactggcaagatgatgtcggtgatgcagttcagtattacgaagaattctatcaaaaattaaaagcggcaaaataatctttgcacacaaaagaaatgctcccattggagcatttctgttttgaaaataagcttaagctaaattcccaactaaatttttcacaaattccaaccgctctttatgtgacgtcaatgacttactaaacctaaacttagtcggtccgtcaaatttaaatacagtaggctgagactgaattaattgcacaaatttcatcggatcaagttctgcattttcagaaaactcaataaatcccccattaattgtgctatcaattttgacaatttttaaggtttttgccagcaaacgtaactcagcaatttgcattaaattcttacctgcctccggtaataagccaaaacgatcaatcaactctactttcaattcatctaactctgcctgattttccgctccggcaatccgtttataaaaagataatctcatattcacatcaccaagatattcttccggtaataatgcaggtacacgtaaatcaatctctacttgctgttgtgttaaagtatccaaagaaggttctcgcccttcttttaatacagcgacagcattttccaataattccatataaagcgaaaaaccgatactttcaatttgaccgctttgctcatttccgagcaattcaccagctcccctaatttctaaatcatgggtagccaaaataaatccggcacctaaattatctaaactttccagtgcctctaaacgcttaacggcatctttggtcattgcttttggatgaggtgtcaacaaataagcatatgcctgatgatgagaacgtccaactcttcctctcagctgatgtaattgggctaatccaaaattatccgcccgttcaataataatcgtgttagccgttgggacatcaatccctgtttcaataatagtagagcaaaccagtacattaaaacgctgatgataaaaatcggacattacacgctccaactctctttctcgcatttgcccatgcccaacaaccactctcgcttccggtacaagtgcggtcagtttttctgcacaattttcaatacttgccacatcattatgtaaataataaacctgtcctccccgtaaaatttcacgcaacacagcttctcgaataatcaaatcgtctacctgtcttacaaaggtctttatgctcaatcgtcgtgccggcggtgtggaaataattgataaatcacggatgccactcatcgccatatttaatgttcgaggaataggtgttgccgttagggttaaaatatcaatattggttcgtagctgtttgattttctctttttggctcactccgaaacgatgttcttcatcaataatgagcaaaccgagatcgctgaattttacttctgactgaattaatttatgcgtaccgattaaaatatcaattttaccttcattcaagtgttgtaaaatttgtttctgctcttttgccgttctaaaacgtgacaacatttcgacattaaccggcaaattggcaaatcgatctttaaaattttcataatgttgctgtgccaataaagtcgtaggaaccaaaaccgctacttgtttatggttcatcacggctaaaaatgccgctctcattgccacttccgttttaccaaaccccacatcaccacaaactaaacgatccatagctttttcttggcacatatcagaaataaccgcattaattaccattttttgatcgggtgtttcttcaaaaggaaacgtggcagcaaattgtttaaattcttctttatcatattgaaatgcaaagccttttttaacttcacgttgagcataaacatccagcagttcagcagcaacatcacgaattttttctatcgccttatgtcgagcctttgcccaactatcattaccaagtttatgtaaaggtgcattttcatcagatcctccaacatagcgactaattaaatgcaaagaggtaacgggtacataaagttttgaattattcgcatattccaataataaaaactcagctttaattccaccattttctaaactcaccaatccaccatagcgtccaacaccatgctctaaatgcacaacaggttgtcctatttttaattcagcaagattgcgaatgagtgtatcgggattggcaactctacgtttattacgctcacgttgttgcactcgctctcccaataattcagtttcacaaataatggcaaccttatcctcattatcaataataaatccatgttctaaactactgatgagcaggcttttagctggcttatctttttcacctaaatcctgaatttgcgttggtttgagctttaaaggtaagagtaaatccaataatgtttcccgacgcccttctgtttctactgaaaaaataacagttccgtcaaattcctcaataaactgacgcaatttttgcaaaggttctttttgttgtacttgaacggttaattccggcaacggctgcacaggcaaatttttctgacgaacagaggaacgatcaaattttttgctttttaaactcaatcttggataattttttaactgccgattaacttcatcaatacgtaaccacaatttttccggcatcagcaacggacgcatcggatcaacacgacggctttcataacgttgttcaatatcctgataaaaacgttccgcttgcggcacaatttgttcaaaatccacaaacaacgtattgtcaggtatgtaatcaaacaacgtcgccatttgattaaaaaagagcggttgccaatattcgattccggaaactagagttcctttactgatttgttgataaatatgttcaggatctcgtctaatttccgcaaaagtttctctaaattgactacgaaaaaattcaataccttttctatctgttgggaactcttgtgcaggtaataaattaatacgttgaatttcctctaatgtacgttgcgtatctacatcaaaagtacgaatactatcaatttcatcatcaaaaaaatccaatcgaaaaggcaccgcacttcccatcggaaataaatccaataaagcacctcgtactgcaaattcgccatgttccagtacttgttcgactgctcgataaccggcattttccaactgtaaacgaaatctatcgatatttaatcgatcacctcgttttatcaataatacattgtgttgtaaaaattctgccggacaaactcgttgcattacagtcgtaattggtgcaataaagatacctttgttgctatgttgcaactgaaacaaggcacttaagcgagctgaaataatttcttgatgcggcgaaaaattatcgtagggtaaagtttcccaatcaggaaaaaatgtaacaggttgttgagtgaattcagttaaaattttttctaaacagaccgcacttttaacatcaggggtcatcacaaaaatcaacccatcatatcgccgtacaatttctgcaatcacaagactatcagccccctgtaatacattacctagaagtttatgctcattgggctgggtaggtatgtcaaaattaaaatacatcatattcaaatggatttatgttgaaaagttgccatgtaatttgcactgacatcttgatttaaccaaaattttccggttaaaagattgtaatgataaccacaaatatttttacagactaaatttgcttggtcagtccaatgcagtaactcagccggtttgataaatttatcgtaatcatgtgttcctttcggtaacattttaagtatatattctgcacctaagaccactaatgcccatgctttaaatgtgcgattaatagtcgaaaaaaataagacaccattcggttttaataaagctcggcaagactgaatgatggataaggggtcaggaacatgctccagcatttccatacaagtaatcacatcaaatttttcagcgtaaagtgcggtttgtttttgtaaaaattcttcaacagtaatttgctgataatctatgaccagtccttgttccttggcatgtaaacgagcgacttcaagaggagcaacggtcatatcaattcctgttactattgccccttgctttgccatagcctcagacaaaataccgccaccacaccccacatcaagcacttttttttccgttagtccgttagcttgctgttggatatattgtaatcgtgtcggattaagttgatgaataggtttaaaatctccattcggatcccaccaactttttgccattttttcaaatttttctaattcttgcggatcaagattttgcatttttatcagtccgtatagcagtaaaaaacaattacgctattattccttaactgcgttaaaaattcactacaaaatttcgagaaaatcagaagttatgctataatctcgccaatttttcgtacctaattaggaaatctcaatgactgattttacccccaacgttactcctgtgagtatagaagaagagcttaaatcttcgtatcttgattatgcgatgtctgtaattgtcgggcgagctttgcctgatgtacgtgacggtttaaaaccggtgcatcggcgtgtgcttttttctatggatcaaagtagcaatacttacaataaagcctacgtaaaatctgctcgtgttgtaggggacgttatcggtaaatatcatcctcacggtgatagtgcggtgtacgatactattgttcgtatggcacaacctttctcgttacgctatatgttggttgatggtcaaggtaacttcggttcggtagatggtgatgcaccggctgcaatgcgttacaccgaagtgcgtatgcaaaaaatcacccaagaattactcaccgacttagataaagaaacagtggatttttcgccaaactatgatggaaaagaaatgatccctgatgtcttgccaaccaaaattccaacattattggtcaatggttcttctggtatcgctgtgggtatggcaaccaatattccgccacataatttaaatgaagtattggatggctgtttagcctatgtggataacgaagaaatcagtattgatgaactaatgcagtatattcctggtcctgacttccctacagccgctttaatcaatggacgtaaaggaattgaagaagcatacaaaacaggacgaggaaaaatctatgttcgtgcaaaagcggaaattgaaactaacgataaaggtcgagaaaccattgttgttactgaaattccgtatcaagtcaataaagcaaaattagtagaaaaaattgcggaactcgtgcgtgaaaagaaaattgaaggcatcagtaatgtacgagatgtgtcaaataaagagggtaaccgtgttgaagtagaagttaaacgtgatgcagtcggtgaggtcgtacttaataatctgtatgccttaacccaaatgcaagtgacgtttgggatcaatatggttgccttagatcatggtcaaccaaagctattaaatttaaaacaaatcattgaagcatttgttcgccatcgccgtgaagttattactcgtcgcactgtatttgaacttcgaaaagctcgtgagcgtgcacatattttggaaggcttggcaattgccttagcgaatattgatcctgttattgaattaattcgtgcctctaaaaccgctgatgaagctcgtgtcggtttattatctcaagcttgggaattaggtaatgtagcaacaatgctcagtgcaacagacgtagatagttctcgtccggataatttggctgataacttaggcatcatcgacggtaaatactatctttccgatgaacaagctcgtgcaatcttagatttacgtttacaacgcttaacggggcttgaacacgaaaaaattgttactgaatatcaagaaatattaattgaaattggcaaacttttacatattctaaacagtgcggatcgtttgaaagaagtcttgtgtgaagaactggaaaaagtaaaagaagaatttggtgatgcacgtcgcactgaaattacatcggcatccggcgatattaatttagaagatcttattacccaagaagatgtcattgttacactttctcatgcaggttatgtaaaatatcaaccgcttacagactatgaggcacaacgccgtggcggtaaaggtaaatctgcaactaaaatgaaagatgaagattttattgagcgtttattagttgccaatactcatgacactattctttgcttttcaagtcgaggcagattatattggttaaaagtatatcaactaccgcaagcaaatcgaggggctcgtggtcgtcctattgttaatattctcccattacaagaaaatgaacgtattacggcaattctaccagtggctgcctatgaagaggataaatttatcgtcatggcaactgccggagggcttgtgaaaaaaattgcgttaaccgaatttagtcgccctcgttcaagcggtattatcgcgcttaatttacgtgatgaagatgaattaatcggcgttgatattacagatggtaccaatgaaatcatgctcttctcatcacaaggtcgagtagttcgttttgaggaaaattcagttcgagcaatgggacgtttagcgacaggggtacgaggtattaaactggcattaacaaatgatatttccgatgatgaaagtgcggtagaaattgaagatatttctgatgaggatacaaaagaacctcttgatctcaatgtagataaagtggtgtcattggttattccaaaaaatgacggtgcaattctaaccgctacacaaaatggttatggaaaacgtaccgcactttccgagtatccaaccaaatctcgtaatactaaaggggtcatctcaattaaagtcagtgacagaaatggtaaagtggtcgctgcaacgcaagtagaggaaaatgatcaaattatgctgattaccgatgcgggtacattggttcgtacgagagtgagtgaaatcagcattgtcggacgcaatactcaaggtgttcgactcattcgaacagcggaaacagaacaagtcgttagcttagaacgagtttgtgatactgatgaagatgaagaaaatatcgataacgattttgaatagagaacagactaaatcatcataatttcaagggcgattatcgccctttctttatgtccaaaaaatatgactctctaccttatttatacccacttaatatgtgcttttttagcttggcattactgattattcgagggctgatacaaatggataataaatcagcaaaaatactcaatccgctcttttttcctgctttactctgtctaagtgcggtcgttttttctcggattttttcataattgaaaaatcaataaaatatgtcattatttaatccctcatttctctacaaaaaagctattttccctttttggtaaagcaaatttttttgctatactcgaacactgcttttattaggagaaacaatatggaacaaatgccgaattgcccaaaatgtcagggtgaatacgtatatcacgacacaattaattttgtttgtcctgactgtggaaatgaatggtctgacaatgaaattgaacaacaagacgaagatcaactcatcgtaaaagatagcaatggaaatatattaactaatggcgatgatgtgcttttaattaaggatttaaaattaaaaggatcttcagaagtactaaaaaaaggcacaaagtacaaaaatattcgtttagtaacaggtgatcataatgttgactgcggcaaattattactaaaatctgaatttttaaagaaagcttaaattataactatcatgtttatctaaattggagttgttatgaaaaataaaattctcggcagtgcattaatgatcgccggcacaactataggtgcgggcatgttggctatgccattaacctcagccggcatggggttttccatgacgttagtgctacttgcaggattatggttattattgacctataccggcttgttgtttatggaagtttatcaaactgcaaaagaaaaagatgtaggcgttgcaactcttgcagaacagtatttcggtttaaccggacgttttttggcgactattagcttgctcgttctactctatgccttacttgccgcttatattaccggtggcggctctcttttatcaggccttttaacgggtattggtgatgaaaaacaaacttctcaaatctcaatattactctttactctaattttaggtgcatttgttgtgattggtattaaaggggttgacggcttaacccgcctcttgtttatcggaaaaatcattggctttattgcggtcttattaatgatgttacctaaagcaaaattagaaaacctaggggcaattcctttagataatctattggttatttctgcaattccaattttctttacctcttttggcttccacgtcattatggggagtatcaatagctaccttgatgcagatattcgtaaaatccgtttagccattattattggaacgttaattccattatttgcctatttattatggcaattcgcaacacatggcgtattaagccaaactcaatttgttagcctattaaaacaagatcctaccctaaatggattagtaaaagcgactagtcaaattactggaagtagcctattaggtgaggtagttcgcctattctcatctcttgcattaattacttctttcttaggtgttgcaatgggaatttttgaaggggttggtgatctattaaaacgtattaatctgccgacaaatcgcccgatactggcacttttaacttttattccgccactagcctttgctctattctatccaaacggttttatcaccgcactaggttatgccggcattttatttgccttctatgggctacttcttcctgttgctttagcttggaaagctcgtcagttgcatcccaacctaccttatagagtcgctggcggtaatcttgcattagtcatcgcatttattatgggcatcgttattatcgttatcccgttcttaatgcaagaaggtatccttcctactgttgccggataaattaaaaagagcggttaaatttttataaattcaaccgctctttctattaaattttaaaaataatgcctcacaattcatattatgaagtgttacgtttatctaaaagcaatttagtctactattttttcggtaaaacgttcaattttcgcacccaatccacgtaattttttttcaatatgctcataaccacgatcaatgtgataaatgcgatcaacgatggtttcacctgtggcaatacaaccagctaagacaagactgatagaagcacgtaaatccgttgccataacttctgctccggataaatattcaacaccatgacaaaatgctgtgttaccttcaatctcagcctttcctcccatacgaattaattcaggaatatgcataaaacgattttcaaaaatagtctcggtaattttacttgaaccctctgcaaccatatttaataaagtaaattgagcttgcatatcagttggaaaaccaggataaggttcagtacgtatatttaccgcttttggtctattaccttgcatatccaatgtaatcgtattttccgtgacttcaattttagcaccggcatcacgcaatttatcaattactgcatctaaagttgatgctttagtatttttacaaatgatacgtccgccggaaatagcggctgcaactaaaaaagtaccggtttcaatacgatcaggcacaatactatgctcacaaccgcccaagcgttcaacaccttctatcgtgataatatctgaacccgcaccgctaatttttgctcccatcttatttaaaaatgcagcagtatcagtgatctcaggttcacgagctgcattttcaattactgttatgcctttcgctagagttgcagccatcataatagataaagtcgcaccaacacttactttttcaataacaattcgtttaccgattaattgaccatcaacaaaagccttaacataaccgtcttccaatacaatttttgctccaagtcgctccagcccgctgatatgtaaatcaacaggtcttgcaccaatagaacaacctcccggtaatgaaacttgcccttgtttaaaacgagatactaaaggagccaatgcccaaatagacgcacgcatcgtcttaaccaactcataaggagctacaaaatgattaatatttgaagcatctaaatgcaccgcaccttgttcatctcgataagttaccacacctaattgttgcagaatttttaacgtggtatcaatatcttttaactcaggtacattagttaatttgacaggctcttcagctagaatggccgcaaacaaaataggtaaggcggcatttttagcaccggaaatattcacttctccatttaaacgagactgcccataaacacgaaatttttgcatatgttacttcctacttatgctacatattcaataaacgatcacgcttccactgttcagtactgaatgtttttattgttaacgcatgaatcgcaccggatttaaaatgtgccattaaaggtgcataaatagtttgctgttgttttagtctggacagttgtgcaatttcatcgtttacaacaatgacaccaaaatgtgcattttcaccctgaacatatacttcatcgagattcaatgcttcctttaaaatttgctcaatttgctgagtttccattaatattttccactattgtaaaaaaggcttaagccaatcagataagccaaaaagatctgccaaaatttccaattgaattggggcattatgaattttttgtgaacttacttgtttttcaagctcattaataaaatcacttagcaaagcaaaaccagcactatcaatgcgattaacttcactgagctcccaaacaagttgctgaccaacaagctccgcacttgataaaagttcatcacgttgttgcaaaaaaggaagcaatgtatctcgtgataacgctcccataattcggagcgtcatcttatcactatttttttctaatgcccaattcagattgttctttttcatacgttatttactactaataataattggttgtttagaaaattcttccatctcatcaatcaaagtttctataccttttttgcgtaaaataggtaaccattcctgtcttgttgagtgaaccgtactcacgccgttagcggacatatcatacacttgccacttacctgatttactgttcttacgccaataaaactctaaatcaataggtgcaacattgccactttgcagtattttaaccggcacattcatttgatctgccgttacattaatcggctttaatacactaattttctgattactataaagcgttaatgctttggcatattgatattcgataaatttatcaaataccgcaaagaattttgcacgttgttccggtgatgttgatttaaaataaggccctaacactaaagatcctgcataatttacatgagcatagggcatgagtccttgacgtacgatagtacgcaaataattaggatcttgtttaatcttactttggttagtatcaatggctttaaataaacgctcagatacatcaagcgttagttcataaggtgtttcttccgccatagcttgtacagcaaaaagtgcggtcattgccacaattattttaaaaaatagtttttttaacataaatattagctcctaaatctacagtgtataaaaaattattgaacatccgattccaattgcttttgagtgcttttattttctttactgccatataagaattgcccgacaagatcctccaataccatggctgatttagtatctacaatacgacttccctcttttaacatggaagtttcaccatcatcaaatccaacgctaagggaaatatactgctcacctaacaaacctgaggttttaattgataatgaactgttatctggaatttcattgtacttttcatctatagcaattttaaccagcggtaaataggttttatcatcaagttcaattgatgatactctgcctattacaacgccaccgactttcaaaggagctctaactttaagtccaccaatattatcaaaaacagcataaacttgataagattttgcttgattaaacccttgtatattcgcaactcttaatccaagaaaaaccaatgccccaataccaattaataaaaataatcccacccaaaattcatatttaactgtttgtctcataaaaaatccttaattttctaccgcactttatttatgaacctgcaccaaacatcagtgctgtcagcacaaaatccaatcctaaaacaacgagagaagcatgtaccaccgttttcgttgtcgccttactgattccttccgatgtcgggatacaatcatagccgttgaataatgcaatccaaacaacagcaatagcaaaacataaactcttaataaaaccatttaataaatcatagctccaactgaccgagttttgcatcaccgaccaaaaactcccagcatccacacctttccaatccacaccgattaaagaaccgccccaaataccaattgcggtaaaaataacggcaagaatgggcatagaaatcacacctgcccaaaaacgaggtgaaataactcgacgcaaaggatcaactgccatcatttctaagctggataactgctctgttgctttcattaaacctatttcagccgtaagagccgaaccggctcgaccagcgaataaaagtgcggttacaacagggcctaattctcgtaacaatgataatgcaactaattgtccaagacttgtttctgcggaaaaatccactaacaccacatacccttgcaaccccaacaccatgccaataaataaacccgataacatgatgattaacaaagattgtacacctaatacataaagttgtttaatgagtaaagggaaatgcttcctcatctgttgtttcccaaccaatgcaccaaaaagcataaaaccggctcgccctaaagaacgacaaaaatccattccccatctacctaaagatgaaataactcggatcatgaaaacaactcctgtacatagtcttgtgcaggaaaatgaaaatgaacaggtccatcttccttaccttgaataaattgcacaacttgcggatctcggctttgtaaaagttgctccgcacttccttcagcgatcactcttttatctgcaataatatacgcataatccgcaatacttaatacttcctgcacatcatgagaaaccacaattgaagttaatcgcaacgcttcatttaaacgtttaattaagctaataatcactcccatactaatgggatcttgccctgcaaaaggctcatcgtacataattaactccggatcaagtgcaatggtgcgagctaatgcggctcgtcttgccataccgcctgacaattccgacggcattaaatttgccgcaccacgcaaccccacagcttccaatttcatcaacacaatttgacgaataagtttttccggtaaatgtgtatgctctcgaataggaaaagcgacattatcaaaagttgataaatcggtaaataatgcgccggactgaaataacattcctatgcgttgacgaactcgatataactcactattggacattttacaaatatcttgctcatcaaacaaaatttcgcctttttcaggttgaagttgtcctccaatcagttttagcaacgtggttttaccaatgcctgacggtcccataattgcagtaattttgccttgctgtacctgcaaattgagattgtcataaataattcgattacctcgcttaaaagttaggtttctgacttctattaaaggtcttgtcatagtttcttcattactctacttatatttgtacaaaatgagatcggatattccacgaatttccggtcattgtcaaattaaattatgatgattttcaaccgcacaatccaaacgagatgtctaagttaacaccccagactttaatagattattacatgcttttttaaaaactatgctatgattacgcaatttttgtcaaacacaaaacaatataaggattttatgcatattcgctggaatattattttatcggtgatagctcttgttttactcgcttggttttatactttacagccaaatgataatgaactcagtcagcttataaagtcaagtacacagccggaatacataggagaaaagatgtcaacctctgttttttcgccaacaggaaaaaaacaatatttagcgacagcagataaaattgaacactacaatgaggatagacgcacagaatttcaccaaccgctggtctatttatttgatattgatgatgaaaaattcggtacgcaaagttggaaattaagtgctaaaaaagctaaattaacaaaaaataatatgctttatcttgatggtaacgttattgcagaaactttattggataatgctaaattacaacgagttatgacagaaagtgcggtagtaaatttaactactcaagacatcacctctgacacgatggttactataaaaggtcaaaatttcagctccaccggcttaaaactgaccggaaatttacaacaacaaattgcaaccttaaaagaacaggtaaaaacccattatgaaatcaacaacaaataagtatttattaattaccgcacttatgatgacttcaatatcagctttagccctaaaagatgatacaaatcaaccgatagatatcgtatctgaccatcaatcccttgatatggaaaactctgtggtaacttttacaaataacgtagtcattaaacaagggtcaattttaattaaagcgaataaagtcgttattactcgcccaacagaaaaatccaataaaaaagaaactgttgaggctttcggtaatccagttctctttaatcaattacttgataatggaaaacctgttcagggcaaggcgaataaaatccactatgatctcagtgccgaatttttaactttaacgggtaatgcggaattaaagcaactggatagcaaaattaacggtgaaaagatcacctatgatgtcaagaaacaacaactcaaagcaaatggagccggaacatccagagtaaaaacagtattaattccgactcaattcaataatcaacacaagaagtaaccgggtaaattaatatgtctatactgcatgcagaacatctcgctaaaagctataaaaaccgtcaagtggtttctgatgtaagtttaacagtgaactctaatgaaattgtaggtttactgggaccaaatggtgcgggaaaaaccacaacattttatatgatcgtcggtttaatacgccatgatcaaggaaaaattcacattgataacgaagatatcagtttgttgcctatgcacaaacgagcacagcgaggaatgggttatctgccacaagaagcctctattttccgacgattgagtgtttatgaaaatttaatggcagtcttggaaattcgtaaagatttaaatatgcaacaacgccgtactcgagctgatgagctgattgaagaatttaatatcggtcatatttgtgataatttgggacaatctttatcgggcggtgaacgtcgtcgtgtagaaattgcacgtgccttagctgcaaaccctaaatttattttattggatgaaccttttgccggtgttgatcccatttccgtaattgatataaagaaaattatccaagatttacgcaatcgtggattgggtgtgttaatcactgatcataatgtgcgagaaacactggacgtttgtgaacgagcttacattgtcagctcaggaaaaatgatagcaacgggtacacctgctgaagtcatgaataacgaacaagttaaacaagtttatcttggtaaagaatttaaattgtaattatgcttaaatttactgaattactctctcctgaaaatatccgtcaagggttaacttgtacaagcaaaaaaagagcttttgaaatcatatccagcttaattgctaaacaactttcagaacaaattgatggcttagaagcagatgaagttagtcttcaggaaaaagaaactctttgtaccgattctttactcaaccgagaaaaattaggcaattccagtttgggaaacggtatggctatgcctaaaggaagattacccctaggtaatacacctatcgcagtcttcttacaactgagtgcacctttaaaatatgatgcacttgatcatcgtgaagtcgatcttatttttgccttattatccccgacagaacattgttccaatctcgttcaagaattgccccatttagtagagcgtttaaaagacaaatctctaattaaacaattaagaaacgcacaaagtgcggaggaaatttggcaaatttttcaattttcagatagacaggcggaaacattaccaactactgaacaacaccatgctgaaacaaaatatcccgaggaagaataaaaatggagattatcattattagtggacgctcaggtgcaggaaagtccgtagcattgcgagcattggaagatattggctattattgtgttgataatctcacgatggatttagttcctcaacttgttgatatgttggaaaacaaacagcatttagtagcaatcagtttagatattcgtaacttacctcaagaacctgaaacattggatcacatcttaaatttgctgcaagaaaaatatccggtaaaaattattttcttggatacggatagaaataccttaattcgccgttatagcgactctcgtcgtttacatccgttatcggtccaaaatctgtctcttgaagcggcaattgctgcagaaaaagagcatcttgaacctttagtacaacatgccaatgtaattattgataccacaccgctttctccccatgaacttgctgaacgtttacgtgaatttttgcatggcaatacggaaaaagaattacaaattattgtcgaatcttttggatttaaatatggtattcctttagatgctgattatgtttttgatgtacgttttttaccaaatccacattggaatcaggaattacgcccaatgacaggattagaaaaaccagttatcgaatttatgcaaaaacatattgaagttgacaactttatttatcagacacgtaactatattgaaaactggttgccaatgttagaaaaaaataaccgcagttatttaaccattgcaattggttgtacaggcggtaaacatcgttctgtttatatcgctcaacaaattggtgaatatttccgagcgaagggaaagaaagtgcaaatccaacataaatcattggaaaaacatacacaaaataaataaccccaaacttaaattcggggttattttgtcagtaattatttaactcgttgtcccgcttttgcacctgcatcaacatcaagtaaatataaatccgcaccaccgttgcctgcgcttaaaatcataccttcagacattccaaacttcatttttcttggtgctaagtttgcgaccataatcacaaaacgcccctccaaatcttccggcttaccatacgccgctttaattccggaaaatacttgacgagtttcattgcctatatccagtataaatttcagcaacttattactttctggcactgcttcacatttcaaaactttcgctacccgtaaatccactttgaaaaaatcatcgatagtaatgctttcttcaattggctcaaactcggaaaatgctttattttctaccgcacttttccctgcggtttggttagctttcgcattttctatttttgaagcctcgatcatttcttcaatttttttcatatctaagcgtgaaaatagaggtttaaacggtgcaatttgatgatctaacaaagggcttgctacattttcccaagtcaattgcgtatttaaaaatgcttctgcacgtgctgctagatttggtaggacaggtttcaagtaacctattaatacgcggaataattcaatccccattgagcacacttgttgtagttcagcagtacgattttcgtctttggcaataacccaaggtgctttttcatcaacatatttattggctttatcagtaagtgccataatttcacgaatcgcttttccaaactcacgattttcatagtagtcggcaattaactctgactgtgcaataaattcatcgaacaacattttatcatctaatttattcgccaatttcccgtcaaaacgtttttgaataaaacttgcatttcttgaagctaaattaactaatttattcaccaaatccgtatttacacgctgtacaaaatcgtccaaatttaaatccaaatcatcgatacggctgcctaatttagcagcatagtaataacgtaagcattcaggatctaaatatttcaagtaagtagcggcttgaataaacgtccctcgagattttgacattttctcaccgttgacagtaacgtagccatgtacgaaaatattattcggtttgcgtaaactggctccatccaacatcgccggccaaaataaactgtggaaatacataatatctttaccaataaaatgataaagctcagcatggctctctttgctccagaaactatcaaaatcaataccgctctttttgccacagagatttttaaacgatgccatataaccaatcggtgcatctaaccacacataaaaatatttattgtcagtattaggaattttaaagccaaaataaggtgcatcacgagaaatatcccattgttgtaatccagcctcaaaccattcctgcattttatttgcgacttcttgttgtaaagaccctgaacgtatccattctgttaacatcgccccaaaagcaggtaaatcaaagaaaaaatgttcactttcttttaataccggcgttgcacctgatactgttgaacgtggtgaaataagttctatcgggctataagttgcagaacaaacttcacagttatcgccatattgatctgccgccttacatttcgggcaagttcctttcacaaaacgatcaggcaaaaacatcgctttttcaggatcgaaaagctgagaaatagtacgagttttaataaaaccattttgctttaatttatgataaattgcttcaactaactctctattttcatcactgtgagtggaatgataattatcaaaactaatgttaaaaccactaaaatcagccatgtgtttttgttgcacatctgcaattaattgctcaggttttacgcccatttgatctgctttaagcatgattggtgtaccatgagcatcatctgcacaaacaaaataaatttcattgccacgcattcgttggaagcgaacccaaatatccgcttgaatatgttctagcatatggcctaaatgaataggtccgtttgcatagggtaaggcacaagtaactaaaatttgacgtgaattcgttgacattaatttaacctttaaatatgaaaattttgttgttcatcttaccttattagtggtattttttccagctctcgatactttacaatcgtagttatgctatgatgaccgtagcaatttaacttgtttctttaggaaaaaagaatatgacaatccatttttcacataacctctctgaatcacaaaaacaacagttacaagaatgtttccgacaatttagtcatactactttacaaaaagatttaattagcttaggtgcggtcaaaaaaatcgaacttggcggcaatatgttacgcatagagttagtgatgccctttgcgtggaacaccggttttgcacaattaaagaccgcacttagcgataaattagaagcaatcacacgagcaacagaaatcaaatggttacttagctatcaaattgccactctaaaacgagcaaataacctgcctgctgtaaaaggtattaaaaatattattgcagtaagttccggcaaaggcggggtaggaaaatcaacaatctccgtcaatcttgcactggcattacaaactcaaggagcaaaagtaggtatcttagatgcagatatttacggaccttccataccgcatatgctaggcgttagtcagaaccgccctacttctccggataatcaacatatcgatccaattcaggcacatggcttagctgccagttccatcggttttttaatggagccggacagtgccacaatttggcgtggcccaatggcaagtagtgctttaagccagttattacaagaaacactttgggcaaatcatggtgaattggattatttggtgattgatatgcctcccggaaccggtgatattcaattaacgttatcacaaaaaattcctgttaccggtgctatcgtcgtaactactccacaagatattgcattacttgatgcaatcaaaggaatttcaatgttccaaagtgtacaagttcccgttcttggtattgttgaaaatatgtctgttcatatttgtagtcaatgtggtcatcatgaaacgattttcggaacaggcggggctaaaaaaatggcacaaaaatatcaaattaaactcttggcacaactaccgttacatattcaattacgtgaagatatggataacggtataccaactgttatttctgctctagaaagcgaaatatcacaatctttcttacaattagcagaaaaagtagctactgaactttattggcaaggtgaaattattccaggagaaattttattcaaagaagtaaattaatatccaagaaatttctagcgtcgggtttgtcctctcttgttcgggctatgatagcatttctctctaattcagcaaggacgcttaatagttgagttaatgctatagaaagaggggtattccgtgctgttgtatcaaacattccgtctcgtgttttaaagtcgatttttctatcgtgaaattcagttataacacctataacttgtaatgcaccctgacctatctaggctagcaacaacatcccccctctcggatataattcagtaattctagcctttctgcattcttttccctagttccctgaattttgcagcctgcttttttaattggtttatttggtcttttaagtcctgcttatgagttgatactccagcaaatccaacaaaagctatttttacctctattcaaaagttacataataaaaacaaatatattgattacttctattttgaagcagtttgcgagtaggtatttaaatgagaaaatttcaacgcatcaaattcatcgtgtataacgtattggtaaatcagtactaaattaccttgaatatgacaatctcgatgatctttccattctccaactaatgtgtgatcttgatagctttctggtaacggtaagcgatttaataaacagtttattgcagtcatgtatttttttccaattaacacattcggggagcgtttagctaaatcagttaaatctctagcaaactgttttgaatagctcacttttaatggcttcgttgacattattgacccattaagaatgcgttttgtaaactattcagcagagtaattttcaccagcttcaataaagaaactctctgcgttactactctctaattcatcaatagctgctagggtttctttatttgagcgaagataattcaaatcaatagggatagagcgtgtcttggcaatttnnnnnnnnnnnnnnnnnnnnnnnnnnnnnnnnnnnnnnnnnnnnnnnnnnnnnnnnnnataagcttcggttttagttcgatcaactgttctaaagctgatagaggaattcgtaagtaccatcatttttctcaatagtattacattgaaagactatcataataaggatgaagttaaaaatctacatttttaatgtgattagggattttcatttttaattgctattcagaagttttcaatgtatatttttgaatatagtcaaagataaaaacggagcgttacgccccgtttaatttatttttcactttcttccaattcgtctgccatcgctgataaaatttctctagaaagcaaaactaaagcacgataaaagggtaaatttgcatgcttttctacttggttaaaaaactgactagcacaaggtaacaaaaaaatttcaaatagttctcgctgggcttgaatggaatttaaattatcttcaacccaagaggcagttaaaaaaaccaacgcaaaatgatccgcactttctaccactgggcatcctcgctcttgtctaaacgaagaaaattcatccggattaattccataatcagagattttcattgaaataagtggcgtatcagtcataaataaacgctgatattctatttccagtgcgtttaaatccattggtatttgcaaactatctaacgcctctttactttgtttatctgtttccaaacaccaaacctgttccaaacctttttgttgtaaccaagaaaatacgtctgtcattataggatctgtcggttgacgataaaataaattaccgaacaatcggcttattaaggaaaaattactcatttgatctacaatcacgcaataccttccttttgtaacgctaaaagagcggtgagatttttcactgttttttctcttacttcttgcaagatatgttgcttagcttgttcatctaaaatgtgaatatcaccgaaaaaactatgatcaatatcagtaactccacaataattaaacagaccatcaactaagcaattttgtaatgattgtgcaaatccacgttcttgatatttctgtaaattattacccatagtaataaattgttgtatttttttaccatgtaaaagcctctctgaaacgccattttccgttttgtaggcaaccccatggcttaaaatacgatctaaatagccttttaagattgcaggaaatcccatccaccacaatggataaataagtgtaataagatcagattgatcgattaattcttgttcataacgaatttctgctggtgtgattttttgttgtgccgcctgtaattcttcccaagataaaattggattgaaatcaagagcatacaaatccctaactcgtgtttcaacccccagtttttgaccggtctttacagtttgctctaatattgcttggttaaaactcgtctgattattagggtgagtaaaaataattaagtgtttcatttctttctcttattttttttgaacaatcaacgtaattccattcacagcttgaacttcaataatatccccttgttgcaaccctttaccttgaatacgccaagtggtatcgccaaaaacacctcgaccaatgccattttcggctatcacttcaaccttacctcgacatcccaacatggcgtgatctcgccggtttaaagaagaatttgcctgatctttttcatctttagtatgttgatatttccaccatgcgacactcaacactattgctaagatgccataaataacgcactgtatagtcagagataaatcaataatgatggtgatcattgaaacaacaatagcggctaagccccaccataataaaaaaacgccaggaacaattatctctgcaatcaataataaaaaacctaaaatcagccaatgccaaaatgtccaagcgtcaaaccattccattatacatatttcctctcaatagaggacgcctaagcgtccattgttactgttgtttgtcgccttttaacagttcagcaatacctgcaaccgagccgattaaatttcctgcctcaagtggcataagcacaatcttactattatttgcactaccaatttcttttaatgcctcagtgtatttctgagcgataaagtaattgattgctttggtatctccgcttgcaattgcatcggataccatttgtgttgctttcgcctctgcttcagcggctcgttcacgagcctcggcctgtaaaaacgcctcttgtcgttcaccctccgcttttaaaattcgagattgtttttcgccctcggcacgtaaaatttcagcttgacgcacaccttcagcctctaaaatatcagcacgtttattacgttcagctttcatttgtgcattcatcgctgcaatcagctcttgcggtggacgaacatcacgaatctcaatacgtgttactttaattccccaaggattcgttgcttcatctacaatagctaataaacggctgttgatattatcacgttgagaaagcatttcgtctaattccatagaacctaataccgtacgaatatttgtcatggttaaattaatgatggcttgttcgaggtgattgacttcataagctgcacaacgagcatcaataacttgcacaaaacaaaccgcatcgatagacacattagcattatctttagaaataacttcttgcgatggaatatctaagacttgctccatcatattaatacgacgaccgacacgatccacaaaaggtacgacaaaattcaatcccggtgttaaagtgcggatataacgcccgaagcgttctattgtccaatgatagccttgaggaacggtttttaaagttgaatataaaataaatacaattaataaaataaaaataatcgtagcaattggtaacccatcaaatagctccatttcatactccttgcaaaataaaacaaacacaatataaaaatactaccagcatatagtagcttattttagtttatttatctaactaaagtgcggtctgaccaagaatataagatacttattttttagttaaattcgtgacaattttagttaattatttctttatttgacttttattactacttaatccggtctgtttcattggtttgaccacacccatcactacgtttttataaaaagcggtatacggtataatagtttatccatcataaaaaggtaaataccatgtctagatatgcaaaaattttattgttaaacggccctaacttaaatatgttaggaaaacgtgagcctacacattatgggaatctatcgttagaagatattgaacaacacatgcaaaaattagcacaacaacatcaatgtgaactaatctgttttcaagctaatagtgaggaaaaattaatagataaaattcaccaaagctttcacctaatcgattttattattatcaatcctgcggcttatactcataccagtgttgcattacgtgatgctttgctatcagtatctattccatttgtagaagttcacttatccaatatccatagacgagaaccttttcgtcaccactcttatcttagtgatattgccgaaggtgttatttgcggattaggtgctcaaggttatgaatttgcattacaatatgcctcgaactatctaaagaaaataaaataatttgcataaattttaccgaatttcacagaaatttatcgcaaaaatttattttttcaggtaatctctcgggcgaaataattcattttaaattaaccgcacttttttatcctcaattttgtctaaattggggattttaatggcgatttatttatgaacagtattaattttagttattttaggaaatcattatggacgttcgtaaaattaaaaaacttatcgaattagttgaagaatcaggcattatggagcttgaaatttctgaaggagaagagaccattcgcattaatcgtggcacccctgtttccaatcctattcaatataatgttcctgttacagcacctacaccagtagttgctccgcctacagtttcggaagcaaccggtacgccagtaacacaagtaaatgaagagccgtcaggtcatattattcgctcaccaatggtcggtactttctatcgtagcccaagcccagaagccaaagcttttattgaaataggacaacatgtcaaagttggcgatacactttgtattgtcgaggctatgaaaatgatgaataaaattgaagctgataaagcgggaatcatcaaagcaattttagtcaatgatggcgaacctgttgaatttgatgaatctctgattgtaatcgaataattattttacttttataggatttttaccgtcctacaacattattccaagagatagattcttatgttagaaaaagttgttattgccaatcgtggtgaaattgcattacgtattctgcgtgcttgtaaagagcttggtataaaaactgttgcagtacattcaacagccgatcgtgagttaaaacatgttttattggctgatgaaactgtttgtattggtcccgcaccttccgccaaaagctatttgaatattcctgctattattgcggctgctgaagttactggtacagatgcgattcaccccggctatggtttcttatccgaaaatgcggactttgctgaacaagttgaacgctcaggttttatttttatcggtccaacagcggatgttattcgtttaatgggtgataaagtttctgcaattaatgccatgaaaaaagccggtgttccttgtgtacctggatcagacggtcctttaggtgccgatattaataaaaataaagaaatcgccaagcgtatcggctatccaattattattaaagcctccggtggaggtggtggtcgtggaatgcgtgttgtacgtgatgaaaaatcattggaagaatctatcgctatgactaaagctgaagcgaaagcggcttttaataatgatatggtttacatggaaaaatatctagaaaatccacgtcatattgaaatccaagttttagcggatacacatggaaatgccatttacttagctgaacgtgattgctcgatgcaacgtcgccaccaaaaagttgttgaagaagctccggcaccgggtatttcagaagaaacaagacgtgatattggtactcgttgtgctaatgcctgtcttgaaattggctatcgtggtgccggtacatttgagttcttatacgaaaatggtgaattttacttcatcgaaatgaatactcgcattcaagtagaacatcctgtaaccgagatgattaccggtgttgacctagttaaagagcaacttcgaatcgcagcaggatttccgctttcaattaaacaagaagacataaaagttaaaggtcatgccatcgaatgccgtattaatgcagaagatcctaagacctttttaccatcccccggtaaagtaacacacttacattctccaggtggtttcggtattcgttgggattctcatgtttatggtggatatacagtgccaccacattatgattcgatgattgctaaattaattacttatggtgatactcgtgaagtagcgattcgtcgtatgcaaaatgcattatccgaaactattatcaatggtataaaaaccaatatacctttgcataatttaattctttccgatgaaaatttccaaaaaggtggaacaaacattcactatcttgagaaaaaattgggtatgagagattaatatcactctcattgagttataaaaataaaagcaaaagtggataatagtatccgcttttttatggataaaaaatgaaagtacattacaaacaatcagctaaagaatctcgctatgccttgttcttaacagtgctatatcttatcggctggtgcatttttgcctatttacctgatgaggcaagaggtccacttggttttcctctttggtttgaattgtcttgcatatactttcccatagtgtttattatcatcgtgtatttgtgtattaagttcttttttaagaatctatcattaggagaggaaaaatgaacattaatatcattttacctttggttctctacttgctctttgtattcggcattgcttactattcctatcgtcaaagaagtcaaggcaatttcttaagcgaatattatattggtaaccgctctatgtcaggctttgtattagcgatgacgacagccgccacttatgttggagcaggatcttttataggcggaccgggtgccgcatataaattcggtttaggttgggtattgttagccatgatccaagttccagtagtcttgtttactttaggggtactgggtaaaaaattagccatgctggcacgaaaaaatcaaagtttaactgttaatgatattttattctctcgttataaaaatccctatattatcctactggcaagcctttcattgctgttttcgttctttataatgatgtccgtgcaatttatcggcataggtcgtttattagaaactacattacatatcgactaccacatttcagtactcatttttgctaccactgttggtatttacacttttataggaggctttagagcggtagtactgaccgatactatccaaggcctcatcatggttttgggaacctttttattactgggcggtgtcatttatgcaggaggagggattagccaacttattgatcacttagctaaaattgatccgcacttaatcacgccttatggcactgatgacagaccgcttgattttacatttatggcttcgttttgggtattagtctgctttgggttactgggtttacctcatacagttgtgcgtgctattgcctataagaatagtaaggcactacatagcggtattattatcggtacaatcgtcatcgctgtactaatgcttggaatacatttagccggtgctttagggcgtgctgtaattccaaccttagatgtaagtgataaaattattcctactttgatgatacaagtattaccacctgtagttgctggtatttttcttgccgcaccaatggcggcaattatgtcatctgttgactctacattaatccagatgtcctctactctgattaaagatctatatttacgtttttaccccgctcaaatacacaatgaaaccagaataaaacgcctatcaatattaacaactttatttctaaccttactcgttaccatagcaaccttaaatccgcctgatatgttgatctggttaaatttatttgctttaggtggactggaaaccacatttctatgggttatattatttggcctatattggaaaaaagctaacgcttatggtgctattagttcaatgttagtcgggctaataagttacatattacttaccgctcttgacataaaattatttaatttccacgctattattcccgctttattatttggcttaattgcattcttattgggaaatcaagtaggaaataaattgattaaaaatgaggaaaaataaatggcttgggtacaacttcgtttaaacagtacaaatgaaaaagcagaaaaaatcagtgaatatttagaagaaatcggtgcagtatctgtcacttttatggatagtcaggatacgccgatttttgaaccgctaccgggggaaacccgtctgtggggaaatactgatgtgattgccttgtttgatgcaaaaaccaatatgcaacaaattgtccgcctattgcaacaaaaaaatcatcttgatgaaaatactgcttataaaatcgaacaaattgaagataaagattgggaaagagaatggatggataatttccatccaatgaaatttggaaaacgcctatggatttgtcctagctggcgtgaaatacctgacgaaaatgcgataaatgtcatgcttgatcccggtttggcttttggtacaggcacacatccgacgaccgcactttgtttagaatggttagacagcttagatttaacaggaaaaactgtgattgatttcggttgtggttcaggtattttagccattgctgccttgaaattaggcgcaaaaagtgcggtcggaattgacattgatccacaagctattctcgccagttataacaatgctaaacaaaatggtgtagcagagcgtttacaattatttttatcagaagaaaaaccaaccgatttacaagcagatgtggtgattgccaatattcttgccggtccgttgaaagagctttacccgataatcagcaatttagtcaaaccacaaggtgatttgggcttatccggtattctatctacacaagcagactccgtttgtgaagcatatcaagggaaatttactcttgatccgataactgaacgagaggaatggtgccgaattaccggaaaattaaacccatttgtctaattcatttatatgattttatacaaaaaataaaagtaaattatataaaatttaaccaatatcaaaaaaatgtaatttgtataaaaaatattctttgcaaatgacttaaaagtgcgtatcataacgcaccttgtcgccttgactagcgaaagcaataaatctgatatagcataatttggagaagcagaagtgcaaattggttcttatcaattaaaaagtaatgtacttttagctcctatggcaggcataacagatcagccttttagaaggctttgttctttttatggagcaggtttgacttgctctgaaatgatgtcagccaatccacaagtttggcatacagaaaaatcaagattgcgtcttgcccatcatcaagatgcgggaattaacgctgtgcaaattgctggttccgatccagttgagatggctcaagccgcacaagtgaatgtagaatatggtgcacagattattgacattaatatggggtgcccagctaaaaaagtgaaccgtaaattagcaggatctgctcttttacaatatcctgacttagttaaaaaaattctatattcggtagtcagagcggtaaatgtaccggtaacattgaagattagaacaggctggaatcaagagcatcgtaattgtatcgacattgcaaaaattgctgaacaagcaggaattcaagcattaagcatacatggacgtacacgtgaatgtttatttaatggaaatgctgaatatgacagcattaaaaaagttaaagaacaaatttcgattcctgttattgctaatggtgatataacaaccgcaaaacaagcacaagaagttctcagttatacgggaacagatggaataatgattggacgtggggcattaggtaaaccttggctatttcagtcaatagtaagcttaatcgaaacaggtatcactattccggagccaagtttagatgaaaagtgcagcgtgattttgcaacatattcgtgatctgcatcagttttatggtgaagataaaggatatcgcatagctcgtaagcacgtatcttggtatttagagggaattcaacctaattccgattttagacagacttttaatgcaattacgaatgctaaagcacaactaattgcactagaagatttttttaattttattttattggataaagaaacatgttagaacaacgtaatccggctgaagcattaactgtttcagtattaaattcacaatctcaagtaacaaataaaccacttcgtgattcagttaaacaagcattaagaaactatttatcacaattagacggtcaagatgtgaacgatctttatgaattagttttagcggaggttgaacaccctatgttagatatgatcatgcaatatacacgtggtaaccaaacacgtgcggcaacaatgctgggcatcaaccgtggcactttacgcaaaaaattaaaaaaatatggtatgggttaatttcccttgctgaaaaaatgaggtcgctaatttggcgaccttttttaattactctatttcaatttttttaataaattctgaattcaaatctaacaaaggcaaatctgaaccttgccaagaacgtaaaatttgataatccattaaacttaatgtatccaaccccggcgtaacatttggcgtatattgttttgcgatacgtgctaattgggttaaacccaaactactttcaatagacgaactaatcactgcttttatacctaactgatgagcttgctcaatcaacttagcacaatcttgcaacgaaccagtcaaagtgggcttaatcacaattgcggctaagtgcggttctttttctaattgaaatcctttttcccgaatactttcgtcccaagccaacgctatacctgtatcctgtgcaaattgacgactatcttcctgcgttttacaaggctcctctaaaaactgaatacgcttgcgatgttcaggctttacatatttagcaaacaactgggctttcgccaatgtccagttacgattagcatcaaggcgtaaataaagatcgggaatagcctctaacaacatatcggcaatcataccatcacgatttgcttcatacatgccgaccttaattttcgcaaccttttccccttgcatttgatttaatgcatcataaagctcatcaggatcgccataacataatggtgcaacttgatagcttccctcttgctccaattctcctttcatttcagccaaagcacaacttaaaccaaaagcaacggaaggatataacccttttaatgaaaggctacaattttcagagcttgctttatcccaatcttttagccattgaatagcttgatctttcgcctgttccagtgtttcttggctaaattcaggcaagggagcaatttcaccccacccctcgaacgaaccgcagtttatttgcacaagcaacccttcacgcttcttcaaaaagcgattacgcaaaataagctggctatccacaggaatagcatattggtataaatgaaaaattcgatttgtcattactgttcacattgttgtgtattgtcattataacgaccaccataatctaaacagtgatcttttgcatcaaaaataacgaaagcggcaaaaatacctagcaccactaaaatcagtaaaagaaacaaccattttttcaacattattttttcctcaaacaagataaaagtgcggtcaaattttccactattcttaccgcactttcactgattaaatttatggatttcgcttaaatttactgaagtcaggtgcacgtttttcattaaacgcattgcgtccttcctgcccttcttccgtcatataaaataacatagttgcattacctgccagctcctgtaaacctgcttgaccatcacagtccgcattcaaagctgctttcaaacaacgcaaggcaattgggctgttgcgtaacatttcacgacaccaacgcaccgtttctttttctaaatcagcgtaaggtacaactgtattgaccaatcccatttccaatgcttcttgggcattatattgacgacataaaaaccaaatttcacgtgcttttttctgtccaacgatacgagccatatagcttgccccccaaccaccatcgaatgatccgactttgggacctgtttgcccaaaaatcgcattttccgctgcaatagttaagtcgcataacatgtgtaaaacatgtccacctccaatcgcataaccggctaccattgccaccacaggttttggacaactgcgaatatcacgttggaaatccaacacatttaaatgatgcacaccgctttcatctttatagccaccgtaatcaccccgcactttttggtctcctccggaacagaaagctttttccccttgaccggtaagtataattacaccaattttttcatcaaaacgtgcatcagaaaatgcttggatcatctctttaactgttttaggacgaaatgcgttacgcacttctagacgattaatagtaatttttgcgataccgtcagtagatttatgatacaaaatatctgtataacctgaactgaaatcctgccattcaacaggcacataaagcacatcatcatttggattttgcattatttattccttttttattaagtcaatttgtggttggtattatagcttaaataccaataaaaagtgcggtcgtttttgtggaatttttacttagaacagcccattactccgtagcatattgaataaccttcgtgtatgctcatactgagttaattaatctatctgaacaaaaaaatcgcatgaataattagtcatctaaaaccgaatacaccatcttatttattctgcataattaaaaaaacgccacagttctatctgtggcgtttccaaatttgagcaaaataaattatgcttgacctttaaccgcttttaagcctaaaaacggtgctttctcacctaatgcttcttcaatgcgaattaattggttatattttgcaatacggtcagaacggctcatagaaccggttttaatttgaccagctgctgtaccgactgccaaatctgcaattgttgcatcttcagtttcaccggaacgatgtgaaataactgcagtataacctgcatctttagccattttaatggcggctaacgtttcagttaatgaaccgatttggttaaatttgatcaagattgagtttgcaatccctttttcgataccttcttttaagatcttcgtattggttacaaatagatcgtctcccactaattgaactttatcgcctaatactttggtttgatatgcaaaaccgtcccaatcagattcatcttgaccatcttcaatagacacgattggatattctttgcataacccttctaagtagtgagtaaattcttgagaagtgaaagatttaccttcgcctttcatttcatacataccgttttctttgttatagaattcggaagaagcacagtccattgccaatgttacgtctttacctaatacataacctgctttttctaccgcttctttaatgcaagcaagtgcggcggcgttagactcaagattaggtgcgaaaccgccctcatcacctactgcggtgcttaatccttttccttttaacactttcgcaagattatggaacacttcagccccaatacgtaaagcttcttttaatgttttcgcaccgaccggttgaatcataaattcttgaatatccacattgttgtcagcatgttcaccaccgttgatgatattcatcatcggcaacggcatagaatatacacccggtgtaccgttcaactctgcaatccaagcataaagaggcatacctttagaggcagctgccgctttagcatttgctaaagaaaccgctaaaatagcatttgctccaaattttgatttattttccgtaccgtccaattcaatcatgatttggtcgatttcagcttggttgcttgcctcttttccaactagtgcggtagcaatttcgttatttactgctgaaacagcttttaatacacctttacctaagaaacgagctttgtccccatcacgcaattctaatgcttcacgtgagcctgttgacgctcctgatggcgccgctgccaatccaacgaaaccaccctcaagatgaacttcagcttcaacagttggattgccacgagagtcgatgatttcacgaccaattactttaacgatttttgccattttgttttccttctatagttaatctaaaataagtataaaaactggcgatatagtaaagctatttcgtatgtttgtcttgtaaaaaagcactttttttgattttaatccatataaattgaaagaaaaaatactcttacatatttatttttgtaattttataaaattacaattatttatattgccagtatggagaatatttattaaaattctgctatgtcatttaaataaggtatagttttatgttgttaagtaatattgtggagatcagtagcggacaggcacagtttcgtctttccgaagtcagtgatccaattgcacctgtttatacttattatggtcaggcaaacttagaacaagatctctatttatctgatggttcagcagtacttcctaaagaaataaaaacttttgataaaataaccagtttactttccactggtgatgtgatttttagtctgatttcaggtaaggcaacgattgtcagcaaacaacaccaaggttttttatatactcaaaattacgttaagttaatacctaaaaatcagatagatgccaattatttagtctatttattaaacgaaaatgcggtggttaaaaagcagttaagtcgtggtttgcaaggatctcaagtattgaaatatacgactaatcagttgaaatcattgagattacccaaattaccccacttatcggaacaacgtttaatgggagagatttacctaaaacaacaaaaattagcttatctcaaacaacgcatagcgaatttagaaaaattacttgtgttacaccaattgcaaaagcgagtacagcatgactaagaaaatacccgaattaaaatttgaaaaaaccttaattgaatatctttgtacaggaacgattacagcaacggataatatgatcggcgaaccgcctgcggattatgtagtgcgtaccaaattgtggcaatatgagccaagcattaaaacgacggaagatttatgggaaaattttaaaagaattttagaaaagctcaatcaaaaaaccttagatcgtcctttaagtgcggtggaatttgcacaagttaaacgtactatttctaatttatccacgccttatgccgcagggcagtttctttatggcacaaacggtgtgtcacaaattgaaattgatttagatgatgatcgtcatgtgtttttaaccgtatttgaccaaaaacaaatcggagcgggcgatacggtgtaccaaattgtgaatcaaattaaacgaccggcgattattgcaggaaaagaaaatcgacaatttgatactacgttgttgattaatggcttgcccattattcaaattgaagaaaagaaagaaacgcatgatattaacgaagccttaaatcaaatgcaccaatatatcgcggaaaatcaatacagcgatattttttctacgttacaacttctgattgcgattacgccaaacaatgtgaaatatatggcgaataccacagcagatcgctttaataaagattttgccttcaactggcaacgtcaatcggacaataaaccggtttatcactggaaagcctttgccgattccatgttgagtattcccatggcacatcaaatggcgactaactatatgattttagatggtacgccgaataagcaaaccctaaaagtaatgcgaccttatcaagtttatgctacgcgttgtgtgatggataaactcaaacgggcggatttcgatcaagcgttgaataaactcggttatatttggcataccacaggttcaggcaaaactattacgagctttaaaaccgcttggctggcaagtcgttcgccgaaagtggataaagtggtttttttagtggatcgtattgcactgactaaccaaactaccgaaaactatcgagcttatgatcctgatgccacggaagatagcctaggtagtgtactggataccaacaacaccacagatttgaaccgcaaattacacagcaaaggcagccaaattattattacctctgtgcaaaaactggataccttggttaaacgcacttctttcaaagctcccgaaaaaaacattgtgtttattgtggacgaagctcatcgttctacaggcagtgataattttgctgcgattcaaaaaaaatttaaacattctgcgtggattggttacaccggcacgccaatgtttgatgacactaccaaaggcttacgaactgaagatattttcggtgaactcttgcacgcctataccattcgagaagcaattgctgatcgtaatgtgttgggttttaaagtggattttgaaaccacgattagcgaaaaaagtatgaaagaagcgcatctaccgaaattctatcgccttaaatatcctcattggacggaagaacaaattgccttgaagattgccaatctcacgcaacaagatatggacgacagcatcgaaccgagtttttatgacgaaaatgaagaacacgtcagattagtggtggaagatattttcaaacattggaaaaatcgctccaattgggataacaaacgtaatcgtggacgatataacgccttgctgaccacgcacgtgggtggcggcaaagccagtacaccaatggcaatgatgtatttccgtgaattccaacgtatcaataaagtgcggtcagaaaagggggagtttttgctaaaagttgctgtgacctttagccaaaataccagcaataacgacaccatgcttgaaaccaaccaaggattattcgaggcaattcaacattacaacagcgaatttggcactaacttcactatgtctgatgtatcggcttatactcaagatgtcaccagccgtttaaatcgcaccgctgtggacaaacaatatttagacctcgtgattgtcgtagatcagttactaacaggatttgacgcccctgaattaaatacgctttatgttgaccgcactttaaaaggtgcaggactcattcaagcctattctagaaccaatcgtgtagcggatatgcgtgaaaaaccttgggggcgaattatcaattaccgctggcctgcccataatgaaaagttaatgaatgaggcgttgtccgtttacgccaacaaagattccgccaaattatccgatgaagagcgaaaagtgaataataccaaggataagattactgcaccaaaatacgaagaattgctcgatgacaccaaacagattgtggaaaatctgcgagaaataacggataactttagccaattgccaccgtctgaagcgaaaaaatgggaaatgttggaacaattacgcacctataccgccaatattgccaaaatcaagcaatattctgcggaagatgaaaatggtgaaattatcggttttgattatgaaaatccggataaattgattcaagaactcggcatgaccagtgaagaagaaagtatgctcaccaacacattgtccaacgaactcaaactgcatttagcaaaaagccgaaatgtgccagtgatacaaattgagctacaaatgacccacattaaagacgtggaaattaattacgattacttaactgaattaatttccagcttgttggcacaagtagaggcaggtgaaacggaaaaagccaaagaaacggaaaaagaattggaaaaatttgccaacggcttggaagatcgcagttttgcacaacgcattaaccgtgcggcaaaagcgattatgaaaggtgtgttcaaattaaaagatgggtttaaaaaagacggtatttctattgtggaacaagcgaataacgccaaccaagatcaacaatttttggattttcgtctccaatggggattaacggaggtgattaccaacgcccaacttcgacagcttttttccaaacatcaatttcaacaaaaagatttagatgacaataatcagcttacggatttaatcaaacaagcaggtctcacttatctcgaacttgcacaaaatgatgaagtaaaaaaactgacaaaaatgaaataccgtaaccagttgcgtcatgctatttacgaacttgcagatgagtttgtgggggaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatcacatcttatattttttgcaaaggatagaaaaacaaaatgaataacgaaaagaaacttgtaccgaaattacgattccccgaatttactcacgcttgggaacagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagaacaacaaaaaatcggtacattttttaccgcacttgatcgctacatcaccattcatcagcgtaagttggaaaatatacaaaaattgaaaaaatcattgttgcaaaaaatgtttccgaaaaatgatcaagaatttccggagattcgttttcccgaatttacttacgcttgggaacagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagaacaacaaaaaatcggtacattttttaccgcacttgatcgctacatcaccattcatcagcgtaagttggaaaatatacaaaaattgaaaaaatcgttgttgcaacagatgtttgtttaataaggggcaaagatgagctattccattgaatatacacaagaaattgatcggttaagcaaagaaaatgcctatcgactttatgattcaggcgatattcatcgcttagaagtcgggacgacgaaaggcttgcaagatattcatcgttatttatttcaagggctttatgattttgcaggcgaaattcgtgaattaaatatttctaaaggacattttcgttttgctaacgcactttatttaaaaccggcgttaagtgcggtggaaaaaatgcctgaatcaacctttgagcaaattattgaaaaatatattgaaatgaatattatccatccctttttagaaggaaatggtcgttctacacgtatttggttggatttgatttttaagaaaaacctaaaaaaagtggtgaattggcagaaagtggataaaaagttgtatttacaagcgatggagcgtagccccgtgaacgatttggaaattcgctttttattacaaaatgcgttaacggatcgcattgacgatcgtgagattttcttgaaagggattgaacaatcttattattacgaacaagccgaataaactgatttaaagtgcggtcataaatacagaattttttaataaaggaattaaatatgagcaatgtacaaacaattaccggtaaactttgggcaatggcaaatgagctgcgtggcacgatggacgcttcagaatataaaaactatattcttgcctttatgttttatcgttatttatccaaacaccaagaactatatttggtcgataatcatattttggacatagagccttcgcaaagtgtgaatgacgcttatttaacgcaagccacaggtgaggaattacaagattatttgcaagatatttcagccagtcttggttatgccattaatcccgaagatacttgggattcattaatgcggaaaatttacaatgccgaagtgatgccaagtgattatcaagccttatttgataacttcaaccaaaacgccaatttaaatgaagatgcggtgctagatttccgtggtgtgtttaatgatttgaacttaggagcttctcatttgggcaattctaccaatgagcgtgcgaaatctttaggcaatattgtgaaattggtggacgagattgaatacaaagatgatgacggtcgggatattcttggtgaaatttatgaatatttgatcgggcaatttgccgccaatgcaggcaaaaaaggcggagaattttatacaccgcaccaagtttcaaaaattttagcgaaattagtaacgctggatgtggaagataatcaagagactttccttgtttacgacccaacaatgggatcgggttcgttattattgacggtaggtaatgaattgccacaatcgaaacccattaaatattatgggcaagagctgaacaccacaacgtataacttggcacgcatgaatttgatgatgcatggcgtatcctataaaaatatgacgctatccaatgctgataccttagaaagtgactggcctgaaggacttgatgcacaagggattgatcaacccttatgtcgttttgatgctgtggtggcaaatccgccgtattccgccaagtgggacaatcacgagcgtaaattaaaagatgcccgttttcaaccttttggtgctttggcacctgcttcaaaagccgattatgcctttattttgcatagtctatatcacttaggcgagcatggcacgatggcgattgtattgccgcatggtgtacttttccgtggtgcggcagaaggtaaaatccgtaaggcattgattggcgataacaccagcaatgcacaaggaaactatttagacgcagtgattggtttgccagcgaatttattctacggcacaagtatcccaaccacgattttggtttttaaaaagaatcgtaaaaataaagatattttgtttattgatgccagccaagattttgacaagggaaaaaatcaaaaccgcttaacagacgagcatgtccaaaaaattattgacacttaccaagctcgtcaaaatgtggataaatacgcttatgtcgcttctcttgaagagatcattgagaatgactataacctcaacattcctcgctatgtggatacttttgaagcagaggaggaaatcaatattaacgaggtgttaaaacaacttcagcaagataatcaagaaattgcacaattagaaaaagaaatcaacgaacagttaaaattattgggagttgaacttccataacaaggaaagagataaaagaggcaaaagcctctttttttataaaattttgcataatgttaccgcacttttgagaaaaaaactcacgcttgggaacagaggaagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagaacaacaaaaaatcggtacattttttaccgcacttgatcgctacatcaccattcatcagcgtaagtaatacatacaaaggagatatattatgaacgaagtaaattcaaataaagagctgttttatcaatactattcacgctggattcatatgtacaaagagggggctattagaaaagtcactatggcaaagtatctaatgacattagagtggctaaaaaaactgattccaaatctcttgttgtgtgatcttaatcgcataagttatcaacaattactcaatgattatgcctgttatcacgaaaggcagaccacgatggattttcatcatcaactgaaaggggcaattcttgatgcggtagatgaagggttattaccaagagatcccacaagaaaagcaattatcaaaggtcgcccacctcgtttgaaaaaaacaaaatacttaaatcaatttgaactgcatacgttaattacacaattaaatttaaccaaagaaattaactgggattggtttattttattaattgctaaaacagggatgcggttttcagaggctttggcattaacaccaaaagattttgatttttcacatcaaacactgacaattaataaaacttggaattataaagatggtggtggttttcagcctacgaaaaatcgttcatcagtacgaaaaattcctttggattggcaaactattattcaatttgctgagttaattaaaaataagcctgaagaacagcctatttttgttcgtaaaaaaatttttaattccacagtgaataatatcctgattaggcgttgtaaaaaagcaaatatcccaattatttcattacatggtttgcgacatactcatgcgtcattgttgctattcgctggggtatctattgcaagtgttgcaaggcgtttaggacattcaaatatgacgaccacgcaaaaaacatatttgcacattattcaagaattggaaaatcgagatattgatattgtaatgcgttctttatcaaatttaagttaatttagagctacgtcacttacgctgatgaatggtgatgtagcgatcaagtgcggtgaaaaatgcaccgattttttgttgttctttgtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacttcctctgttcccaagcgtaagtttacataaaacaaaaaggctatcaaatgattgtatgataaccttaatgagataacttaaatttttctattttatactataattattttctctgattttccttagtcgcttttacaccacgatagccacagctactaggaattaaaatacctatgcctttcgtttcgacatcttgcgaatcaatgtatttaatattgacttcacctgtcggatttgcttcttgataaaacactttttccccattcagataaatccgcttcttgacaatcaagaaaaaattgctataaagcactctatttttgttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttgttcactatgaatatgaacaattaagaagaactatcaccgcagcagcactatttgtgtctaatttttatttagctcatcgacaaggttattttgacttatctgccaatgaaaatcccattttacatatttggtcattagcagttgaagagcaatattatttgtttttccctcttttactggttattgcctataaaaaatttaaaactcatcaagtatttaaacctatagtattgggtttaatgttgctatttattttaacttcatttatccctcaatcaatttatatcaaaatcggttggagtaatacttattacatttctttcatacgttttccggagcttttaatcggatcttatcttgcattaagtaaaccaagagtaaagcctgttaataattttgttggtttcggtatttttattgcacttatcttaacgctattcttttaccataaatcaatgccgttaatgccaggcattgttctactcctaccttgtattttaaccgcacttcttattcatttctcctcccaaaactcatggggggggggggtaaaaactctcttatcattaaagcccatcgtatgggtaggtaagttatcttattctctctatctgtttcattggatttttattgcttttacgtattatatttcaggtgaaaagaaacttcctcaaggtgcaattttaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtaaagaaacctatattttcaaggttttcaaaaaggaaaatttataaacaatataccttgtagaatayctctggtatctaacaaactataaaaataaaacttttataatagctaacaatataggtataacaaaccaaattctataatataaaaaacggataaatctttttattattgrttcagtttgttcttgatatataagttcacttgcatatatatcagataaatttttatatatttcaccattatctcccatgactatactttcatcattaaatgattcagcaatttccattaagacttttaatgaaatttcatcaggattagagagccataarctattatcatcataagatataaaraattcrtactyatytttataaaaaattcttttttcataatctacggagaatcctaaactcgtcatcttktttataacccgctcaaaatcatataatatyttatcagtgctaagtttatctgacttatttacaatagatacatgatagcccatattatttttcctgcttatctgtaactgttttataaagttctatctaacaaatcgggttattaccacattcctcaagcatagctttacggttagattcgcttatgcctttatatttctcaaaaatcgctttcggctctttaccttctttctcagcttgagccagttctctaatatcacaatagtattatatttattttgccattctttatttgtttcaatttttcatttcttgctttgtatatatttattattttataaacatatgatccgatatttttttcagacatcaaaaaatctttccatataatagttttaccatcaaaaatatctatataatcccaaagggcatccaagttatttccaaaatattctcctaattctggaacttgcttggataattgcttataaaaatcatctggagaaaaaatttcctttccttcaattattatttccatcttccaacctctttaaatgttttataatgatctgtagtaataaataataaaccgtcacttgaatataataatctcgttcctagttgtttatttctacctatattgttattaataccaatatcagcctcataccaaactcttccatctttactaggtaataagttactttcgtttctaaaaatatccccaccaatttgcccttgttttaaaggtttgccacttgaccaattatataatttttagctatatccttagttacatactcatcaggtaattttccggtttttttcaaactatcaatgactagagctgtattttgttctgcttgtaaatctaattttaatttaggatacaacgctacattctcagccccgcttgatacccttagcttagcatcctgcttctcgtaaccttttggtggtgtaacaataggctgtctagtcagatatccttttatttcccttaaagataaagaaccaccacctacagccgccccagcttcaatagccatgctggcataatgaacactacttggcaaggctgcatagctgtttgcattctcatctcctacaaaggtcgccattttacctttaaggctattacttaatccatttacataagatatcactctcaacgcagaaaggtttttataaacttcatcattccctgttcccatttgataaatatggggaagataacaaatcgggttattaccacattcctcaagcatagctttacggttagattcgcttatgcttttatatttctcaaaaatcgctttcggctctttaccttctttctcagcttgagccagctctctaatcagcttttctacctcatagttattgagatagttattctccaccgcactttccccaatctctccactcaatgctgcattttgtacggtgttcaccgtgctatttgattgattgttttatcgggattgtaagaaaaaatatccaaatctatattttcatctgtaaatatcttagagattatatatttaaatctctcatatctgtcatagatgtcagaattatctttagttaaaagggtaaaactatcccaatttggaattatcaataattcaattattcgcataatcccaattaaaatatcttgttttatcaattttgtgtttttataggttattgctatatttatcaaatctttttctagtttccaatactcatcatcattccattctgagtaatccaaccatcttcctatgaatgaattttcatcatataaccttgaataggttacatttctataaaaatctgcgtattctgccatatttaatctccaattttatttaagttaatatcaaaagttccgtttcttgtttcttttttatttaatttttcaggactagctgcttctttccaagctcctccattatgaccatccacatctctagttatatagctattaccttttttaaacacaactgcaccagacttatcatcaaattttgttcactgactttttaaagtttgacgttttccttggttgtcaattgttttcaactctaatcccatcagctaattctaggtctaattccatatctatgatcaaatttataataattttttttgcatcattcgtaattgaaatttctctctcatataactgagtacagatcaactcaagagctataccatactcatcataattaattaaatccattgcattctcacaatcctcttcaggcaaatttttataaagcaaagatagtagatttttcattttttctttcattatattactcctgtttaatagggaatgcggtaattacaccatttcccattggttctacaataaccctaattctaacgccatcaacaactccctcaactttaaatctactcggaacaccctttttagtatacaaacttccttttgttcctgtttgttgtagccattctaaattaggatcagtagcaatattagatataacgtcgagaatttttttctcagaccagtgtattgggaatttagattttccattcagaatatttgtaaaagaaaatttatgcccaccacctgttttatctccatataatatatgttcagctctctgagaactgactagagataccatattttctctagcagttattagattagagacatttttagtaacaactttttgaaatacatttatagcttcacccgtcaataaaatactcggtgcttccaacgatttacccagactaagcatatagccttgcatttctgcggctaacatagagtcgttttctaaagcccaatttaactgctcattccattgttccgctgaaatcaccactttatcaaaggtctctttcgggttttggattacattcgccagtgttgcaacggttttatcaagatttactatcccatcaactgtgccttgtacaccttctacaaccgctttagcttccccaattttcattgcatcataataagcttccgctaattcctccgcattttctttatctttgaaaagcgttttggcaaacatttctatcgattgcttacgttcttctgatgggtgaatgtcatcaccaagaaaattaaactccaccgcattctcagccaccctcattcccgtactcactgtcgccaatgtaccggctgcggtatcactgcctgcagctacaccaccggccacacctgcaatccctttgataacctgaataagttcttgcttttccatttccgtcagttctgttggggatttgccatagacggtttcgcttaagattttcgcacccacttcacccacgcctgtagccactgcacctgccgtcgcactaccacctgataaccgggcttccattgctccccataaaatatgggcaggaatatttaaggcttgtaactcagggctgtctgtcactttcttaatcgcttcattcacataaggcgataccacacctgccacaattgcttctgtcggtttccctgcaacaataaggcttaatgccgcagcgactgcggttgccgcctgtttcttgttaccacccgtttgccattcttttgcagcttgttggtaagcggtagcttcttgggctttttcggttgcagtaacaaggtcgccttctttagccgctttcgctgcttcttgctctgcttgtttcgctttttcctccagttccgctgcttgccgaccggcataggtcatcaccgcacctgcaacattgcctgcctcttgtgaaaggatttgttgttctttcaacaccttattaatgtctttcggtgcttcaacctgtttattcgccttatcaagttcggtattaatccccaacgcttttgctgtggtttggattggatttgtgtctttgtttaaggtgatttccccctcgatgatagtggttttggtgattgagctgtcattactttgactatgcatcggtaagctcggggttatgttcggagcggtttttccttcaaccaacatcgcattttctgctcctttaccgtaagtgcctgagattgaaacacttgttgccttatgacttgattcattttgaatgtcattaaaagtgaggcgattggttngcagttcactgttgtttggggtagttgaagcaatggtrcygcctttcaagtggatgttgtttgcttctatatgataaccgcctttgcctgcaattaaacctgcctgttcattaacttgtttataactgcttttacctttctcacccgaagcaaaaccgctcacactccaagcattaccaaaactcacatctacactaaccccagcctgactgcctttgctgttgtaattgttgctgtcttgcttgctttcaattcgaaggtcgcctttagcattcacatcaattcgctcagcagtagcggttgtgccgttgagggtaatgtccccttggctgttaaacttaatatgttctgcatctaaatgactgttatggtaagtggaactttcatacctacttccacaccaacgttctgtcctcagatttccatttactcccctttggatttattttttatccttactctttcctcccatatgtctagaggaacgaaatattcattctcagcctcttcttttgtgagatcacttattcctttcatatacaaaccaacccaataatcttcctttggtatagctgtgaagccatcttctgaaaaatcatttatcacgatttttgctaatattgatttttctccccattctgtcatttgaggagaactttcaaaagaaatatcaaatataatcaatccttaatctacttaaattcattatcaaaagttacttcataattagaatgaaattgatgaattctactttcagaatctaaagcgtaatgacttttaccctattgtatagaacgtcctaatagtaaggttgaaccactattataataatattcactatcatcaattagaattgcttccatttttaaatactttctctttagatgaataatttccacttccccaaaaaaaaccatatattactatatggtagtcttttctatttgcagaataaaagcactctccaagcccatcaatatcaaaggaaaacattttacaataagattcactatttgaaataggggtaaaaacactactaatctcatctaatctagatgggatatatccattttcatatatatataactcgatcctattaactatatcatttaatcttttttccataagaaaccattcaaactttaataaaaataaaaaaacaaacaataataaaataaatttgataaacttcactatttatcctcctttgtaaaaaatggttttgttgttttattcttaattccagagtgactgccattatctatattaggtaaagtattataattaggtgcattcttaggattagtcgcacctaatttctttaaatagttagaaacttgctttcctagacttaaatttgatttaggatcgaaatatttagctccaaattcggctccataacgatctgatggtaaatcttcatatgaataggcagaatgttttgcaggaggatataaagaatctaatctttcttgccaatatccatgcttaatagcattaagcatcgctctattttctaaatttccatctgagcaataactatttaaaatacaaggaaaatgtctatttatactctctgctatctttattaaattaactttttctgaataagcatcaccggcataaaaaacaaaatgaaccatatctatccaacctgcattctttgtataaatatatctatcagatatactattaaacggtgctgtcgttgcaggtttcagattccatgtaagatcatttaatctaaagagagcatcttctgcttactcattttttaataatcccattttagtagatgtattattaaaaaattcctcgaatccttctactgtcccggcttgagccttattaaccgcattattctccaccgcactttttccaatctctcctcccaatgtcgcattttgtatggttagacagtatgtatattaatagtatttagtagtataaaaatcaatttttccctttagtaaagcttcttttcttccaatccagcacagaaagcaatattttcattatatagcctttttcatatttaaaatttaattcatctccatccttctccaaaaatatataatcgttatctttgctaaataaaaaataaacaaatatagaattatcctccatttcaggactagaaatagataataactttctctgtttagatgaaatgttatcgacaagattaatattatcagtttgagtcatggaacctaaaatatcatcagtaatatttgccaatgtaaatctaagctctgatgtatataactcattaataactgaattaccttctatatatatattgaaaataccattaatccaaaagtagtcatcattccattcagatacaatgtcgcactgtattgcaaatttataaggatctccaaaaaacataattactcctatttaaactttaaatctttgggtataggtaaaggattatcaggatctcccgaactaccagaccaatgatattccccattcgtaccaaagaatctatgaatatttccctgagagtctttcgcatatctaatagttttattagcttcaatcttatattctactgaatttttaaataaatctagtgaatctctcggttctattcctgcattttttctatttcccatcatgccttttgtatgtttaggattagatttatattttacagatattccatcttcaaaatttacattgacaggaacaggaactggtataggggaagatgtcctagtagtatttttcttcgcaaaattattctgcgtattagaattacctaaactattttcttttccaaaaagacgagaagcatttactgctaactcaatacctttttctatccctgtctgcttctcttttatcgcttgaatagtcttctggttttcactttcaaccaactgatagaacttactctgttcttcaaatggcaatccttgaatccaattattcaatgctcctgataaatcatcggcaaaaccaaccgctcccaataattcattcggtactgttgctctgcaatcaatctcacaattagccactaattcagcacgttgtttttcacttaactctttaaatctctgatgaacttcctcaacactctcaccattttgaatcgccgcttttaatgctttttgatattgataaacatctttaatagaaagggcgttaaactccaccgcactttttccaatctctccacctaatgctgcattttgtacggtatttaccgtgttgttcgattgattgtctgtctgcgaaataacaccgcctgcaaccgctcctgcgattgaagctaaagcgataatatgttgccgttcttctgccgtcagttggctagcttcggttttattgtatagtaatttcgccaaggttggtgcagcaagttctgctgttgccgccgaaaccgcacctgccgtagcattgccttttaacgctgtcgcttcaatggctccccataaagcgtgggctaacgtgttgctcagaacatcaacattaccttgttcatccatcgttgcctgtttaattaactcattcactttcgggcttaaactttgtgtcgctatcgcccctgcactttgatttgctaatatcccggttactatagtggtcaatacgttggctgttcggttatatgtgccattgttatcccattgtttttgggcttgtgtcgcttcaataagtgcggtcagttttgcttcaatttctgatgaacttacattcggattcccttgcacttgttctaaggctttttctgcctcttttactttctgctctgcttccgcccgtttgtttgccgtgtaagtttgcactgccgaactaatatgccccaccgcctgaacaatctccttttgctccgccagtagttttttcacctcttttggttttgccacttggctgtttgcttggctaaggtcggtattaatccccaacgcttttgctgtggtttkgattggrtttgtgtctttgtttaaggtgatttycccytcsrtrakmgtsgytttggtgattgagctgtcattactttgactatgcatcggtaagctcggggttatgttcggagcggtttttccttcaaccaacatcgcattttctgctccttttttgctcagtttgccggtttcactatcttggtagtaatctgctcctttaccgtaagtgcctgagattgaaacacttgttgccttatgacttgattcatttcgaatgtcattaaaagtgaggcgattggttcgcagttcactgttgtttggggtagttgaagcaatggtactgcctttcaagtggacgttgtttgcctctatatgataaccgcctttgcctgcaattaaacctgcctgttcattaacttgtttataactgcttttgcctttctcacctgaagcaaaaccgctcacactccaagcattaccaaaactcacatctacactaaycccwgcctgactrcctttgctgttgtaattgttgctgtcttgcttgctttcaatycgaaggtcgcctttagcattcacatcaattcgctcagcagtagcggttgtgccgttgagggtaatgtccccttggctgttaaacttaatatgttctgcatctaaatgactgttatggtaagtggaactttcatacctacttccacaccaacgttctgtcctcagatttccatttactcccctttggatttattttttatccttactctttcctcccatatgtctagaggaacgaaatattcattctccgcctcttcttttgtgagatcacttattcctttcaaatataacattggccaactgtctgcttcttctatatatgcaaatttaacatcgaatgtaccatcattatttaaaacaaatctactttgagtccaatcactaccattcaccttcatttccgattttaaattttcataaagctctaatatatttcttttttcatgaggaatacaacctacagaataattgcattcatccccggcattatttatccaatacattctaaagcttgatatcgtttcatgaaattcacattcaaatatatacttatcagcttctgttggcattagcttccatatttcattagctattttaaaaaataaattgttacactttttgcaattcatactattctccagttggagtgttttttatcttaggaagttcaatgacttttccatttatagagtagttaatatcaaaagaatcaggtcttttactattccctctatatattggtttaatatcaacctccactttcttaccttgctctaaagcttgcttccattgcctttccatctgataccattttcctttcggtccattcaatatctcatccattgctacaagatttattttctctcctgcacctctaaacattgatgccagtaaatgtcctccgcaatcgctttctaaacgacattcccctccggttatggcttgtttagatttattctttatttttaaaaagtttattatttataaaagtttttaaaattagtgccaaatacaaccaaaaagacccccaaaatatatcactaaatgcatcattagcccaataaaaatcatcatatttaagataaatataaatcatgaaaaacacatgttttaacgaacaaaaagagacgataaaaaaataccaaattagccaataaaaaaaactattttttttcattaggtatctcctttttcaaaawtagaaacatcatctaagacgtcttctatagttcccttaagaacatctttatgtttcataattttgattttttcaattaactctccttgattaatattacgaaaaactctagctatatgagctatagataacaatgataccttttcaagttcaacatctccggatgataaaaaagaaaataatatttcttttgttttagaaggttcatcagtatacatacctaacgacaagattactttatgtttaatattattctcaacttcagaagaatttaatattaccattccatctttaaaattaatcttgtctaaagattcatatattaatttactcattttattttcctttatcatgagtataatcaaaaatatttatatgcattcctatttctggatcataatctaatcgctaacttttttcatttgatgatatgcgaccaataacctttccatacccatcactgatttctaaatttcatattatcttccttcacttaaagatgtttcacagcatcatgaatatttttaggtaataattgcatattattagggctactttgagcattatgatgccatgtataacattattaggataatatttgatagcaagccacttgatactcaacattactagtcttatatttttcgataagatttctacctcccaaattcagaacttgagcttcatttaacacatatgaacaacaagcaaattcatcatcatcatcaggattaatatacaaaatcgttatattttcaggtaattgaatgaatagagaatccaacagttcatccgtatcattactatatacctctatatatctctctaatttcgtcatggttctatccttctagtaggatctgcactcttagtttgctttcctgttttataattaaattcaccaaggtgttttcctttatgattatatttctctaatgtgccatgctgagaatcccattcataaatatatccttctctatctttccatctatttcgtagttttcctccaccttgtatcgaagttttacgctttacctcagttaaacctgtaattcctgtaatttcatcttttctaggtgcagggatatatttccaatcattaggattttttgcttttttagcaaaatttgcttgtgaactagactgatttaaagcctcttctttagcaagcaaatgagctacaccaagggctaattcagcccctttttctaaagcactttgttgagctttcaagacttcaatagttttcgtattttcttcttcaactaattgatagaatttactctgttcttcaaaaggcaatccttgaatccagctattcaatgctcccgataattcatctgcaagaccaacagctttcaataattcatttggtactgttactctacattcaatctcacaattagcgaacaattccgctcgttgtttttcacttaactccctgaatttcttatgaacttcatcaacactttcaccattttgaatagctgcttttaatgctttttgatattgataaacatctttaagagaaagggcgttaaactccactgcactttccccaatctctccacccaatgctgcattttgcaatgtatttgctgtagtgttcgattgtttgtttgcctgtgaagtaacaccacctgcaaccgcccctgcaattgaacttaaagtgataatatgttgccgttcttctgctgtcaattggctcacttcggttttgttgtacagcaatttagccaaccttggagctgccagctctgctgttgctgctgaaactgcacctgctgcggcattgccatctgcaactgttgcttcaattgctccccaagtggcgtgagccaagatattaagtggcagattaacatcaccattttcatcggttgttgcctgttttatcaggttattaaccgttggaccgacaagttttgtccctatcgcccccgcactttgattcgctaatacaccggttaaaacagtggtcaataccttggctgttctgttgtatgtgccattgttatcccattgcttttgtgcttgtgttgcttcaataagtgcggtcagttttgcttcgatttctgatgagcttgcattcggattcgcttgcacttgttctaaggctttttctgccaagtaagaataggctttatttaatattaaatttatttgatattattttttttatacataatcctataaataaaggaattgcaaaagataaaatatcacttaaagcatcttcagcccaataaaaatcaccaaatttccaatagatatatataaatatccctatatgctttaatgccgcagcagaaaatactgccaaaaataatgcaattaaataaattatcgtcttgatcattttgacaactccttgttattaaggtatttctttactttttcataatcttttactctattatcaaaatctcctccatactctccaaaagcaccgccaagaatatttccaaaggtagaatctttaaggctaaatggcttatttattataggagaaactattgcactgaaataatcgctgcctaaggtatttccactaggatcttttgataagctggttactgttgcaatacctatattaatcctaatttgattayccaatgatcgatttctggttaaagcacctmctgaaaatgcacctaacgcatcataaggattaatatcttgccctgtaactgttttatatcctacatgagctccaagcgaaatacctccatcaatcaacattccagtggtgttaggatatttagtcgaaaattctcctattacacttgcagttgtttttgccgcagatgaagctcctttagctattttaccaacgtattggacaccttttacagccgcactatgtgctcctgttcccacaaatgaaagccctgttgcaagagagttgctcaaacgtccttcaaaactttccgaatagctatatactctttgagctcttaattttaaatcagaataatccggttttatttgtggtgaatctattggtgtattcaataatctcatttgagctggtacatcgctatattcctttacccacttaaacaggatttctctatctttttgagtaagggtatcaggactggtttggtaggtatgtaataacttgtctgaaacctgatctttctttaataaatattggattagtattgcttcttcaggagttaatatttttttctctactaatctatttaatttagcatattcatgctgtgataagaaattatttttcaccgcactttttgctgtctctgctcctaatatcgttgatgaagtattgccacccgttacattgccgacaatcaaaccacttagctgtgaagccactttgaggagtgtccgttcttcattgtttaattgctctgccgatttattgaaaaccrcatccgaraggaacattgccgtagyctcacctgccacaccggyagtcgctccgacaagggcatttgtacctgatagatgtgcttcagtagyagaaagtaaagcgtgagctaacaaattagccattttactgtcttttgtcattgtgtgaatttgtgcattcagctcmggrgaaatcgcarcarcgacaacttgcccagcastgccaccacttaaaattgcccctaccgtagcaacgacagcatcaagtttacgtctttttgaaccgccctcttgccattccacatmttgtgtttcttttgccttgttattggcataaayattkrctgcykractaatatrysmcactgccygagcaatctccttttgctccrcmagyagttttttcacctctttyggttttgccacttggctgtttgcttggctaaggtcggtrytaatasccaacgcttttgctgtggtttkgattggrtttgtgtctttgtttaargtgattttcccttccgtaagcgtcgctttggtraykgarctgtcaytrcyttgactatgcatcggtaagctcggggttatgttcggagcggttttgccgtaagtgcctgagattgaaacacttgttgccttatgacttgattcatttygaatgtcattaaaagtgaggcgattggttygcagttcactgttgtttggggtagttgaagcaatggtrcygcctttcaagtggatgttgtttgcttctatatgataaccgcytttgcctgcaattaaacctgcctgttcattaacttgtttataactgcttttacctttctcacccgaagcaaaaccgctcacactccaagcattaccaaaactcacatctacactaaccccagcctgactgcctnnnnnnnnnnnnnnnngactgtcttgcaatctttcgccgttttctccccgtcaggtaaagtccgtctgtgtcgcctgaatatcaccgcttcttgccctaatctcaatctgtttggcgttgacggtgttgctacttgtatctaatacaagcggtaaatttaccgatagagtttgcaaaagtttaatcaaaacaaacactttgctgaatatatcctataaaccaaaatttgaaatcaaatcagaatcaaatattaatttttttgtatcgtatatgtatattaaattaggagggtagcgatccccaataattaacatataacgatcttctatataatcatattcatgtataaatgctaagctatcatctatatctaaaggaaaaacatacatttcttttgctgttggttttaaacctgataaacaacaatgtaagctctctggtaatttgccgttttctttctcatatttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatattttttgacctatagcttgatagattttttgaatttccattatttactctcttgttggtgtatttctataaatttcatttattttatttcctccattgactttataggaaatttagcataaatctcttctttcctattcactctgtccctccaaatttctaaaggaatataatattccttagtttcttcttcagttagatcacttattcctttcatatatagcatattccaactatcttcctttggtatataagcaaattgaatattgaattctcctgactcagtaagtgtaaattgacaatgagaccaaaaatttccatctaatttcattaagttatttaaatctctaaataaaaaaattaattttgtagcgatttcatctggaaaatcattcatactatattctttttttatagactttgatgtaatccaaaaaagcttacaactttctgtattaggaaatatctcacactgaacaacatattctttggcttcaatagacattattgaccaaataaccttagctatttcaatatattttctctcatataaagcaacattcattaaactattctcccgtagcagtattttttaaatttcttctatttatactattatcaatagagaacttaatttcaaaactatcaggtcttttactattccctctatatattggtttaatatcaatctccactttcttaccttgctctaaagcttgcttccattgcctttccatctgataccattttcctttcggtccattcaatatctcatccattgctacaagatttattttctctcctgcacctccaaacattgatgccagtaaatgtcctccgcaatcgctttctaaacgacattcccctccggttatggcttgttgatatctatttctgtcatttacctctaattttaaacgaccttttacctcttctacccttcctaatgcgtccgttttatactcatgcccattactcagcttataaannnnnnnnnnnnnnnnnnnnnnnnnnnnnnnnnnnnnnnnnnnnnnnnnnnnnnnnnnnnnnnnnnnnnnnnnnnnnnnnnntacttttttaatgactttcttatcaagaaattcacctattttcttagccgcatctcctctattcgccgtattaaattctgtaccaacaaccaaatctatagtagctaaagcatcatcccacgtcagctctccatcagctaaggttaaaagattatctgctatatctaacccttcttcttttaatgtcgcttttaaatcatctacacttaatctgccgttttttactcgctttttcgctgctttaataataacctttgttcctgccacaaaggctttggcaaaattattttcaaccgcactttgagtaacttcactatctacactcaaattggataatgcggaagataatgtttcacctgacaccccattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatataccccactgcctgagcaatctccttttgctccgccagtagttttttcacctcttttggttttgccacttggctgtttgcttggctaaggtcggtattaatccccaacgcttttgctgtggttttgattgggtttgtgtctttgtttaaggtgattttcccttccgtaagcgtcgctttggtgattgagctgtcattactttgactatgcatcggtaagctcggggttatgttcggagcggtttttccttcaaccaacatcgcattttctgctccttttttgctcagtttgccggtttcactatcttggtagtaatctgctcctttaccgtaagtgcctgagattgaaacacttgttgccttatgacttgattcattttgaatgtcattaaaagtgaggcgattggttygcagttcactgttgtttggggtagttgaagcaatggtaccgcctttcaagtggatgttgtttgcttctatatgataaccgcctttgcctgcaattaaacctgcctgttcattaacttgtttataactgcttttacctttctcacccgaagcaaaaccgctcacactccaagcattaccaaaactcacatctacactaaccccagcctgactgcctttgctgttgtaattgttgctgtcttgcttgctttcaattcgaaggtcgcctttagcattcacatcaattcgctcagcagtagcggttgtgctgttgagggtaatatccccttggctgttaaacttaatatgttctgcatctaaatgactgttatggtaagtggaactttctccgttggctttttgactaccgccaccgacagtagcataaacccctacaccagtttgtgctcctgcttgagcaaacatacctacttccacacccacattttgcccacgggatttttccttggttcgactttcgcctgcttctatttctatcttgtttgcatttagctcaatccgactgttttcaaggcggttgccgtctttgtcttttgacacaatatcagcatgctcaaggcggatattacctgtaccgctttggttgtgatttgccctcgattcagttgataaagtgcggtcggttttgttactgttttgtgcgttgctttctgtgttatcacctcgagctgttagcaccacttcttttccatttaacacattcccttgactaagatgagcttcactttcctgtaattggcgactgtgagcgacacctgtgccactttctactcgtatcaaataaccggtattcggcgttttattggcaattttataaatgctgtcggctaatgtataaccctgagccgccaaacctaaggcttgtgcagtctgaagccttgtagaggcctctttgttttttaccacccgttcaactgtttggataatatcaataatcggcgatttgatgcgactaaattgtccgattttcaaatcactttgactttgttgttgtgtttgctcattatgagctgccactgcttcaatattctctgcggtaatatgcagtttgtttttcgacagtatttgacttgaggtttgatgataatccttgcctgcattgatttccacattaccattaagactgacaacttgactgccttgatgacggagactatcaccagcttgattaaaccgctcacgatgataaccaaagaaacgctctgtttctgatgtcgccacctcaccaatggcgtgatgttttctcgcttggcgttgagtttgtgtggtagtcgccgtcgtaaaaagaatatcacctgtcgcactgaagctgttattgccttcacttaccaacactaaacctttacctatgatgtcgccctgttgagcagtggtttggctgtttccgcccacggaaatcaccgtgcctttttcctcaatcaacgattgcttgccgttttcacgccctttgccaacacctgctatatatttatttaacccgttaacctcaaatcccttattggaactgttcgccgattggctataacggttgatggctacatcaaaatgaacatcgccggcagccgtaaaggtcgcatctttttccacagataaagttgcaccttgggtgatgatatcgccaccggtagcgactaccgttaaattgccttgcgtgtctatgtttgcactttgagcaatcacctgttcagtttgtttgttggattgatgactttggtgcttgatgtaaggctgaatacctcgcattatcataccggtagtatccgtaatagcctctgctcgtgaaagctcatcaccaacaaatccatttgcaacaccttgctcttgacgttgtttgtatttttcttttcctacttcaatcgggttgtacaccatattcacaccaaccccaccggatttgctgacatagcgactttgcccaaggtgatgctcatccaccgcattgatatttaccttactaccttgaagatgcgtatcgctaccactatggatttcagtagcattcaaggttaattgatgttgagccgttactcggatattgccttttgcattcagttgtgttgcaaccagctcctcattgtgacttcgattatttgattcagttttattgcgttgatagcccaccgacacaacaccattcgaaagactaccactcaaaccgctttttttggctttctccctatagtccgtcatttttgtattgatgagtacattcaaatcaatgtcttttgcagtaatatcaatatgttgtttcgcatttatatcggtagcttcggtttttaatttatcacctgccacaagtacaatactgtcaccttttaacaagctaccctgatagttatcttgctgttcgttatagtgcgtttctttacttttcttagaaatagcattaccgcttttatagcgatgctgttcctcaagtgttgatactgtttttattgccccaaataccatctcatttgttgcaagtgcggtcagttttttcgctgtttcaatcgccgtactttgcgtgtaaagattattggtttctaggcggatattgctgttgctttgtatccggctaataatgaggttttgattggtttcttgacggcggtggtcgcctgtccctagtttttcactgtgttgggtagaaagtgcggtgctttttaggctgtttttaatattaagcaggctgtcacctgtgccactgttaataatatcactgccgatttggttaagattgtcggcgttgatatataatgtgccgtcttcgcctttcacgtggagtaatgccttacggtcaaggtgcatgtttttataatggtacccataacttggattgctactttcatcggttttcgtggttgagcggtgtgaaaatgtgccacttacattcaaggctaatctgctttgtgcttcaatgtgtccgccttcattagttaaatcccctgatgtctgaacataaagtcgttgggcggataaggtaccttgattatgcaagctatcgccatttaactgcatcacttcccgtccgaaaatcctgccttggttaatcagttcgctgttttttgcataaatgttattcgctgaaatcaggctgccttttgtggttaatggtgaaaaatctgctttgttcgctacaagatagactttcggtaccaatacttcttgttgacttccattaggtagtgtcactgtttcagtttccagccacacaatatcggaagtcaaccttgccctttgtgctttactcagtttcacgccaggtcgtagggtaaattcattcgctagagtttggctgaatttaactgccgaatccattaaggcttgatattgcacttcaaaatcttgctgatgccctgaagggagtttaccggttaattgataaagttgttctcgcacaaggcgttgttcatagtagccgtcgcctaaacgtttttgtacttgatttgagtcataacgaagagcattaaacatataatcactacttaaccatttacggtaatcggtaaaggctggggtggtttccactaaaatatgactgtccgcttgcggattgatttgataaagagaagaactcggtagtattgttgtcccttgtgtaaaacgaatttcacccttgccgtctgttattttaataaatggagctgtagtttgagaattgctttgtactgtcgtagcaacggcataatccccttgagtttgactaaataccacatttaatggaatagtcacattatccacggtatggcggtcatgtcgtcctccccatttgcgttggaaatagcgtttgaaccctcctcgccattttgaccaagtaaattcgtgattaccgaattcttccgtagaatgaatgccttcttcatcagtgtttttaaacggactattttcatcttgacttactaaatttccaccggacagtattagcgaacggtcattatgcaccgcaccttgaaaccacatatcgccaccagccaatattttacccggtgcggtttgtttcaccaccgtttggctgattttgcgacggttgaggttaatgtcccaaaagcgatcatagattttgttggaaaaggcggcgttgtgcttttcaattgccttttctaattgctcaaattgtgtctcattggctttcaaccaatctaaataaggtttcagttgcaatgaaagtgcggtctgttttgcctgatattctaacttgtttacctcataatccgctttttcggtttcatagctttgtagacgtttagcaaaatccgcttctgactcattattttctcgagttggtttttcgggttcattgggaatgtcaaaataggcttgtaacagatttacatcaggataatctttgagggtcaaatgtactttttcatctaaatgaatattaaaatgtgaccaagccccgtcattaggtagatacaaagaatgtggtttaatttgacaatttttcttaccggtaagattgctgcaactttcttcattcggcatcggtaagacataaccgttaaagttgccattggattctctctcttttaactcagttgctcgagatgctactttaccggctcgactaaaagatatccaacgcaaggtgttaaaatcaattttggcagaattaggttgtccttcgggtaataaataatgttcatttaattgggtatcactttgtaattcaaacgctgtttttaaatgttcgttactattgattaaggatttcactccaaaataagcattgccagccacatcaatcaacccactttgatttttaaaattatcggcaaaagatgagttttcagaagataactcgacttcctcagttgaattcaaacggcgaccgacaaacaaatccccctgactcaacagacttggaccttccgtgatttgaccgttttgcttttctgctatggtcaaaaattgtttttggtttatcagttcaggtgctgccaaatccaatcgtttatgagcggcaatgacggcggatttaacatcgttattattgcttgatagttgctcgtctcgattgacaatacgagcaccggcttcaatggcgactttatcgcctaatatttgtcccgtgccaatattttccaccgtctctgttgctttgataactgtcttttccgttcctaataccgcgcctcggttaatcagagatttttcactttcaatccgattttgtcttcctcgaatcacaccgctcgaagtctgttcgatattctcttttgcttttacctcaaccctatcttctgcgtacagcttgcctgcattatctaaagtgcggtcggttttaagacggttttttgtcgctgctattatttgaccggatgcggtattcacaatcttgccctggctatcaatcactacctctgagctacttgcaccaatatgtcctgcattgcgtaccccaacgccgttttctgtaccgataagataaattttgcccgaatacattccgccaagctctgctacatcaagggaaaattgcggttgtgactcgcctgaaacgtgttgggttgtgtgaataatttgcaaagttttgtcggaatcaaaccgcttgatactatttttccctgtgataacggttgcttcttttttcgaccaaatccctgcattcacttccgcttctcgagcgaggatttcagtataatccacacgactgttgtccaagcctttgccgctgacattgattttaccggcttcaaccttaaaactctccacttccccgtttttaatctcaggcttgcctgtagaaagtgtcactcgaccggaatttatcacaccgcaaccttcacaatgtagcccggaggggttggctataatcacatccgctttgccgcctgctacttccacatagcctttcatcacggacggcgaagaagaattgatctcgtttaaaatcactttcgcctcacctcgggcgagataaggattagccgtcacctgccctgcaagttgggtagaagtgcttgtgcgactgttatttaaaattactcctttctcggcaacatcaaattgtgaatatttattatgggaaagccctttggtattgggcgtttgaatattgacttgcggaagcccattggtagtttgtaaaacaatgggttgttgggtttttggggcggatttatccgcttgaataattaaagtttcagcaaaagcagaagagaaaaacgaagaaaaagaaaccaactccaaggcacaaaacaaactgaaacaaagagcttttaacagagctaaaagcgaagaaaaatcgaccgcactttttgaacaaacagaagacgaacatgaagatttgtcttgggattttgcaagttctgatacaacgattaaacgttgtaaggggttactaaaaataatgcaaaaatgttgtgtgttcataataaatcctcctgatttttccgttttgattatcccaacctgccattcggcgtttttgtacttcaatttccgacttatcaatatagttttgcgattgatgtgaccaaagtgcggtggaaattgtggtttttctgtgactgtcacgataaatcaaataagacaaaacaatgtaagcttatcggtttcactttcacctgaataaatatagctgttatcaaatgcccattgatggataggatagcaaggcaattcagtataagatagcaaaagtgattcagtaggagagatatttaggcgaatatcgggtttaggctgtaatttatcatcttttgcctgctgatgttgttgggctatatcgtttaattgagtattaaatgtattagtgaaagtggtagtggatattacggaagaaattaagcttaaaatgagtgtttgatggcatttcataatatcaaatagaaaattatatagtcattctaagtagaatatagaatttatcattttttgcaaataatgttactcagtatttaggaaaagaagagtatggttgatattttgttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaactccgttttatcttttaaatggatggattttataccgaacacttcattccttttggagttttatgtcaatggggattggaatacatctgtcatctctgaatcaacttagcaaaatgcgatcccgccatgtattaagtaaaactattaaattacttggtttgtatgtgaaattacattacatagttttattagttggtgctgatcgctatagtttgcattatatttcaatgagattaagcagttgttgcaggttccattgagaataaacgtaatttattcattatataattcaataagataccgtaagccggcacaaaaaatagaatactaatgaaaattttaaataaataatctacagaaccgatttcgacccagtgttcagccataaacggatcgttacttgcgtagaaagcaataccaaagaatatgaacgtatccgccagtgagccgaataccatagagcaacttggtgcaatccaccaagtttttaatttacgtaaatggttaaatacatacacatctaatagttgcccaaacaggtaagccgcaaaactggcaaacgcaatacggaagacaaatgtgttaaatgatgtaagtacatgtaaaccttgatattggctatcggaaaataatgttgaaacaagatagctgatgattagtgcggggatcataacgacaaaaataatccatcttgcttctctagcaccaaaaactcgcacggttaaatctgtggctaagaaaataaaaggaaaggtgaaagctccccatgtattgtgaaacgaaaaattctccgcaaatcctaaagttgtgagaggaatggtaatttcaaaaggaatttgaacgaggtagttgcttgccgtaatgataaatatatggaagaaactcaagatgattaatgcacgttttttttgttgatcattgaagatcgaagagatgtttttcattttgtgtacctttttgataaataaaattggggttagggaacccaatataaacatgtccaaaattggagacggagaatgatactgaattaagaaaatatttcaactaatatttacaagccaaattgctatttttttgctattctacacgacaatttttatattacatttaatggatcacagtcatgagcgaaccagaaaatcttgcacaaaatcaaccgcacttttcagaagatacaacgcattttggatttcaaactgttgcaaaatcagagaaacaaaaattagttgccaatgtttttcattccgtagcggcaaaatatgatttgatgaatgatttactttctttcggcattcatcgagtttggaaacgctttactattgattgtagcggagtgagaaaggggcataaagtcctcgatcttgctggtggtacaggggatttttccgcaaagttttctcgtatcgtaggtgaaacgggaaaagtgattttggcggatattaattcttcaatgttggacgttggacgtgaaaaattaagaaatcttggtatcgtgggtaatgttgattatgtgcaagccaatgcggaagaattaccttttgcagataatacgtttgactgtgtgataatcagtttcgggttgcgtaatgtaacagataaagacaaagcattacgttcaatgtttcgggtattaaaaccgggtggacggttgttagtgttagagttttctaaacctattttggatcctttaagtaagatctatcatttttattcttttaatgtactgccaaaaattggtgaaattgttgtgaatgatagtgacagctatcgttatctggcagaatctatccgtatgcacccgaaacaggacatattaaaagagatgatgataaatgccggttttgaacaagtcggttattataatttaaccgccggtattgtggctttacaccgaggctataaattttaggatagagtatgttgcctgattttaattctttgaaaacacagtttatgttaccgcagtttattaatgcgggatgtgaactgttattaaattatcttttgcgacggacaagtcatcgtgaaagatacttgcgtcaattacaaggtaagatcttaaagctgacattacaaaaaacacatttttctttgtatttcgttttttcagcacagcaagtggatttattgaaccattatgaaggtgatgcggattgtacagtggatattgcggtaaatttattattgcaaatgccgaaaaaatcggaaataagtcgatttattaatgataattcgcttcaatttagcggggatttgcagatattacaagattttgtggagttaatggaaatgttggaaaaagatccggcagagctgatttctccttacgttggtgatgtgattgcacatagtgcggtcagttttcttaaaaatttaacagaatcgataaagtatcggcttacgcaaggtcagcaattttgggcggagcgtttgacagaagagtggacagtactttcgcccaaattggctgtaatggatttttgcgatcaagtggaaagtttagcaaaacagaccgcacttttagaacaaaaaattaatcagattttagcatgatgaaacttaatgatattaaacgtttatataaaatagtacgtgtttttttatcttatggcattgatgaaattttaccgcataataaatatactcgttcaattcgttgttggcgaatgttatttttttggttaaaaaataaacataaaaataaagcgtttggattacgtttgcgtttggctttacaagagttaggaccggtttggataaagttggggcaaatgttatcgacacgtcgtgatttatttcctgcggaaattgctgatgaattggctttattacaagataacgttgagtctttttcaggaaagattgctcgtcagcaaatagaacaagctttgggttcttctctagaaaattggtttacagattttgatgaaaatgcacttgcttccgcatctattgcacaagttcatactgcaaaacttaaattgggcgaggaacaggaaaaagaagtggtcatcaaggtgttgcgtccaaatattcagccacaaattgaggcagatttaagttggatgtataaattagccagtttattgcccaaattatttcgtgaggggtatcgtttaagagcggtcgaagttattcaagaatatgaaaaaactttgcgtgatgagcttgatttacgtgtcgaaatggcgaatgcaataaagttgcgagaaaattttcttgatagtccgatgttatatattccaaaaatgtatgaagcattttgtcataaaaatgtgattgtgatggagcgtatttacggcattcctgtttccgatgttgagacattacaacgaaacggcactgatatgaagctattggcggaaagaggtgtacaagtcttttttacgcaagtatttcgtgatagtttttttcatgcagatatgcacccaggcaatatttttgtgaatccgcttcgtcctgataatccgcaatatattggtattgactgtggcattgtggggaaattaaatgagagtgataaacgctatttagccgaaagttttgtggcattttttaatcgtgattatcgtcgggttgcacaaatgcacgtagatgccggctggaccccacaagatacgaatattgatgatttcgaacaagcatttcgagaggtatgtgaaccgattttcgccaagcctttatctgaaatttcatttgcacaagttttactgaatttatttaatgtagcacgtgaatttaatatgcaagttcaaccacagttagtgttattgcaaaaaacgttactttatattgaaggattagggcgtcaactttatcctcaattagatttatgggatacagcaaaaccctttttgcaaaattggttgaacgagcaaataggtatgaaggcaacatttaaaaaattgaaagccaaattaccttatttgcaggagcatctacctgattttcctgaaactttaatggacgccttgaaacaacaaaaatttattagtcagcaattagtggaaattaacaagaagttagctaaacaacaacgttggcaaaagaaaatgtttgtattaattgtgggaatagtgattttttctgtaacgttatggcaattcgctgcattgccgttggcgataagtgcggggttattcttagttggttttttagtttggctaatcggttttttgttaccttaatgcgttagatcaaaaataatccagtttagctattgtcactatgatttaaaatggttatattctgcaagattttttattaagtttaatgtcataggagaaataaaatgggatcaagttggcaacaattactaattttgcttttagttgttgtggttattttcggtactaaaaaattaagaaatattggttcagatcttggcggtgcggtaaaagacttcaagaaagcaatgaaggatgatcaacctaaagatgccgaatttaaaaaaatttccgaagaggtagagcaaacttcagtcgaaaattcaaaacaaaaagagcaggcataatctgtgtttgatattggtttctccgaacttgttttactttttgttgtgggcttgatagtactgggaccacagcgtttgcctgtagctgttcgtacggtaatgggttgggtaaggactgtgcgaagcttagcgacaaatgtacaaaatgaacttagtcaggaattaaaactgaaagagttacaagaaagcattaaaaaagctgaagatctcaatatttcccaattatctccggaacttagtgaaaccgtagaagaattacgtcaatcagcacaaaaaattaaaatgaatttagaggagaaagctgctgaaacaaattcttctgttgaagagcaggtgcaagaactgaaaagtgcggtgcaaaattcacagggtactgcaacgactgaaatagaaaaaaatcttgattttccttccggtgagttatctcctgctgaacttgcagagttagcggaagagggagaacctatgttggaacttactgaatctgatttttcagaaaaggagccaacgactatctcgtctaatgaagtgattgaaaatagtaaagaaaaagtatgagtgtcgaaaagtctcagccattaattaaccatttattagaactgcgtgatagattattacgcagtatcatttttgtagtcgtaatatttctcgccttagtttatttcgcaaatgatatttataattttgttgcctcgcctttattagatgtattgcctgccggtgcgacaatgattgcgacgaatattgcgacacctttctttactccgattaagttaaccgcagtagttgctttatttatttcagtgccttttctgttatatcaagtttgggcatttgttgctcctgccttgtatcaacatgaaaagcggttggtatatcctttgctgttttccagcacattgttgttctatctcggtgtcgcttttgcttattatgtggtatttccattggtatttgcttttttgactaagaccgcaccggaaggagttgctatcgctactgatattagcagttatttggattttgttttagccttatttttagcctttggtatatgttttgaagttcctgtggcaatcgttttattatgttggagcggtgtaaccacgccggctgatttaagaaaaaaaagaccttatattattgttgcagccttttttattggtatgctattaactcctcctgatgcgatttctcaaacattgttggctttgccgatgtgtttattatttgagataggtgttatttgtgcgggtttttatcagccaaaagatgaacaggaaaaatcataaaaatgatttgaatttgagtgaataagatcaaattattctctctggtttgtagaaaggattggaaaatgactaaacaaatatttaccggatatcctcaacgccgtttacgtcgtatgcgtaagcaggattttagtcgtcgtttgatgtcggaaaataagctgacagtagatgacttgatttatcctgtgtttattattgagggagaaaatcatcgtgagtcggtgccttctatgcccaatgtggagaggttaacgctcgatcaacttttacttgaagcggaattgatggtgaaatacggtgtgcctgttattgcattgtttcccgtcattgaacaagagaaaaaatccttaatggcggaagaggcttataatcaagacggtttagttcaacgagcggtaaaagcattaaaagcaaatttccctgaattaggtgtactgactgatgtggctttagatccttatactgttcatggacaagatgggattattgatgaatatggatatgtactcaatgatgtaacttctgatgtacttataaaacaagccctttctcatgctcaagcaggggcggatattgttgcccctagcgatatgatggacggtagaattggtagaattcgtaccgcacttgaaaagcaaggctttgttaatacacttattatggcttattctgctaagtatgcctcaaattattacggaccatttcgtgatgctgtcggatctgcatcaaacttaaaagggggcgacaaaaaaacctatcaactggatcctgctaattctaatgagggattacaagaggttgctcttgatattgaagaaggtgcggatatggttatggttaaaccgggtatgccttatttggatatggtttatcgagttaaagatcaattcggcgtgccgacttttgcttatcaagtatctggcgaatacgctatgcacatggcagctattcaaaatggttggctaaaagaaaaagaatgtattatggagagtttactttgctttaaacgagcaggtgcggacggaattctaacttattttgctaaacaggtagcggaatggttgtatttagacgaaaagaataaataatttaaaatagattttactttaacccacttcgtgttagcgaagtgggttttgtttatctacaattgtatgtctaatttatcataggctcgagaaactttttctaacgccttatcaacagaaatatcacgtgcaagaataacacctaaacgacgatgcccattgacttcgcctttgccgaataagcgaatattagtattaggttcttgtaatacttcgaataaattaccaaattgtacttggttagatttgccttcaacgacaatcgcttttgaggcggctgggctaattaaattaatttcaggaattggtaatcctaatatggctcttgcatgaagtgcaaattcagaaagctcttgcgagatcaacgtaaccattcctgtatcatgagggcgaggagatacttcattgaaaatcacatcatctccgcatacaaacatttctacgccaaaaatgccacgaccgccgagttccgtcgtaattttttcagcaatatgttgagcatttgcgagagcttgtgcagacattgcttgcggttgccaagattcacgataatcccctttttcttgacgatgtccgataggtgctagaaatgaagttcctccgacgtggcgtacagttaataaagtaatttcatagtcaaatttaacgaaaccttcgacaattacacgccccgctcccgctcttcctccttgttgtgcatagtcccatgctttttgtaggtcgtctttgctttttaagatactctgaccatgtccagaagaagacataatcggtttgatcacacaaggaatgccaaggttttcgaccgcactttgaaagtcatcaaaattatctacaaattgataatttgatgttggcaactttaatttttctgctgcaaggcgacgaataccttcacggttcatcgttaattgtgtagctttagcagttgggacaacattaaagccggcttgctccaattcaactagtgttgaggttgcgattgcttcgacttccggaacgatataatctggtttttctttttcaattaatgctttcaaagcatctccatctaacattgaaatcgtgtaagagcggtgtgcaacttgttgtgcaggtgcattttcatagcgatctaccgcaatcacttctacaccaagacgttgtaattctataacgacttctttgcccagttcacctgaaccgagaagcatgacttttgttgctttaggggttaaagctgttcctaatgttgtcattttttgtccttttacattgtgttttttattaaaataagatttaagaattgagtaaagtatcatctaaaagcagatcgtcatttttattaatgcttatgcctcgattaagaatattccgtgcaatattatgtgcatcttccaatgaatgttcagtataggttccacattgatattcgtttagttcaggaatttcggcttgatttttgacgtttaaaatatcttgcattgaagctgaccaagcgtttgcaacttgttgttcatttggtgtgccaattaatgacatataaaatccggttcggcatcccataggcgaaatatcaataatttcaatttgttcactatttaagtgatcacgcataaatcctgcgaataagtgttctaaagtgtgaatgcctttaggagagaggatttctttattaggaatacaaaaacgaagatcaaaaacagtgatattgtcgccttttggtgttcgcattgtttttgcaacacgcacagcaggagcattcattcttgtgtgatcaactttaaaactgtcaagtagtggcataatttttcctttagagataattaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtaaattttctttattttattgagttctatacttttcattaccctatcaaattaattcgtcttttttatataaaaatggggtagaatagccgacagaataatccaacataacttcgcaggagaataatcatggtaactcgtaaagaattggcaaatgcaatccgttttttaagcatggatgcagtacaaaaagcaaaatctgggcatccgggagctccgatgggaatggcagatattgcggaagtattatggcgtgattttttaaaccataatccaactaatcctcaatgggcaaatcgtgatcgttttgtgttatctaacggtcatggctcaatgttaatttatagtttacttcatctcaccggttacgatctttctatcgaagatttaaaacaattccgtcaattacattccaaaacaccaggacaccctgaatatggttatgcaccaggtgttgaaactacaacgggaccgttaggtcaagggatcaccaatgcagtcggtatggcgattgcagaaaaaacgttagccgcacaatttaaccgagaaggtcatgaaattgtcgatcatcacacttatgtttttttaggtgatggctgtttaatggaaggtatttctcatgaggcttgttcattagccggtacgttaggtttgggtaaattgattgcgttctatgatgacaataatatctcaattgacggtcatgttgacggttggtttactgatgatacacaaaaacgctttgaggcttacggctggcatgttattcctgctgttaatggtcataatgcggaacaaattgttggtgcaataaaacaagctcaggctgagaaaaataaaccaactttaattatgtgtaagactatcattggttatggttctccaaataagcaaaatactcatgatagccatggtgcacctttgggcgatgaagaaatcgctttaactcgtcaagcattaaattggaattacgcaccttttgaaattcctgctgatatttatgcaaaatggaatgctcacgaaaaaggacaagtggcggaaaacgcatggaatgaaaaatttgccgcttatgagaaagcttatcctgaattagcggttgaatttaaacgccgtttaaatggggaattaccggcaaactgggcaacagaaagccaagcctttattgaaaaattacaagcaaatccagccagcattgcaagtcgcaaagcgtcacaaaatgcgattgaagcgtatgcaaaattattaccggaatttttaggcgggtcagctgatttagcggggtcaaacttaacgttatggtctggttcaaaacccattcgtgcgacagaaaatgtagacggtaattatattaattatggcgtgcgtgaattcggaatgtctgccatcatgaatggtattgcattgcacggcggatttattccttatggtgcaacgttcttaatgtttatggaatatgcacataatgcagtgcgtatggcagccttgatgaaacagcgttcattatttgtttatacacatgactctatcggtttaggagaagacggcccgacgcatcaacctgttgagcaaacaaccgcacttcgcttaattccaaatttagaaacatggcgtccttgtgaccaagtggaatctgcaatcgcatggaaagcggcggttgaacgtcaagatggtccaagtgcattaattttcactcgacaaaatcttgctcaaatgaaccgcacttctgaacaattggaaaacgtgaaacgtggcggttatatcttgcgtgcatgctgtgaaaagggtgattgtccggatttaatcttgatcgccactggttccgaagtggaattagcgatgaaagcagcggaagtgttagatgcggaaggcgtgaaagttcgtgtagtatcaatgccgagtacgaatgtatttgataaacaagatgttgcgtatcgtgaggcagtgttaccaagtgcggtaactaaacgagttgcaattgaagcgggtatttcagatttctggtacaaatatgttggtaccaacggacgtatcgttggtatgaatagcttcggtgaatcagcaccggcagatcaactgtttaaactctttggcttcactgttgaaaatattgtggcaaaggcaaaagagattttataatcagttaaagtttaattttgtgagcgggtaaatttacccgctctttttcagtattatgtagcagttgtacaaagcttaatttagtgtttctgctacattttttcttactctcattacaatttaaaggtaagaaaaaatgaatgccttagaaaagttattatgcgatgacgcttcaagcactgaatttacaaattaaatcaccattttcggcaagttcgctacaatccgattggtttccaaacttacggtaaccacccgtaaaaatagttccatcgggtaacgtgggttttgcatggtttcgatagcccaatcattcgcatcatttacaatgccacttgctttatcgactttcaccgattgacgttcaatcacccattccaatgcaggtttgccgttaaccgcatagccgtaagcctcttcggggatattttccagcgtaaattttttgttataaatcactttagttggatcatcttcatttttgcctgtttcaagattcaagcgttttgggtgtttcattttttccacataaaaatcgctatcagcaccgccaacaatcctatcatttgaaatagataaaccgcctgtaaacaatacgccgttatacatcggcacggtttcaaaatttaaatgatagtgagctaattcacgcccagcattagaaaatgcccaaaaatcgaccgcactttttactctaggaatgcgtggcaattgcttactgagattatccgcatatttttcccgataatcttcgctatgtaataacccatagatatagtagaaaatatcttctttttggatattttcttgctcgccgtaaaattcggtgaagtgttttaaggcttcatcggtgatcgccgagcgtctttggtaagtttttggcggaatttgaccgcgtgtattttgttctgtcattgtttggttatcctgttttattcgtaaatccacatcggaaaacattgtccgttcgcttgtaattgaacatcgggtatctgatcggtaataatcaccgaaaagcccttgctcgttcccagtcctgttatgcaaatcgccaaattctctactcgtagatccacatcgggaagcattgtgcatcgccgatgagatgcagatcggggatctcgttgctgatgagaattgagaatcccttgttgcctgtaactgtgaggcagatgataatgttgtctgtctgtctgtctgtctgtctgtctgtctgtattttctacgctatcaaacaaatcttttgggaaaccttgaccgcccgaatgttgcatattgagatctgggattacatccgtcattacagcagaaaattcttttcctgaatttcctgaaccgcttaaatagatcatttgatttataacattgggagcgggaaataatttgggtaactgatatggacgatggttaaatgttttatcaaaataaatatgatttttagtataaggtctatacaatccttgtcttattttatctttagagaatctttctttttctcctttacttagcttaggataaagactgctagaccaacttattttagaatcatctttatcagcaaactgtacaggatcaatttctaaatttgtttttctttgaatatttaatctatctatttcattattaaaaaatgtaatagaattattcatattttcagataatctttctttagaaaaattgtaaacccaagcatcacgatttgtctgtaatccagctgaataattttcaaatatagtaggttctttattatttttatcttttgagcctaggaccatataactatcaaaattcggatctcgttgatttagccagtcattaaactgatcgggaataatttcctgccattgttctgtttttgtaattccgttaattgaaccaaattcagcgattttttctaatttttcttttcttgatagaaaatcaccaatatcataaaaatgaatattgccatttttttctttatctggatttttaactaaaatagaaatagcaactcctgtcataatatcaaaaacattttgaccttcttttttagccgaaataccagatttaccacgaatggcacctcttaaatggaaaatataaagatcgctaaattcatcgtgtaaacatttacgtaatccatttgctgcattcgtttctaaaaaaccggcattggtaatgaaaccaattactcctttatcttgaatacgatcacttgcccaacgtatcgctttaatatagctatcataaagtgcatttttatttgttgcagttgaatgtaaagcataggtatttctaattttttcttctaataatggataacttgtgttttcattattatcatttgctgatgtttgcccaactgaatacggcggattgccaataatcacttgaatatccaattccttttgacgtttacggcgttcgctgttttctaccaaaatttgatcgatgagatcttctttttcgtacatttggaaagtatcagttaaacagataccattgaaaggttggtaagcggttggattttcgttattttttgcaagtagcgagtgataaacactttcaatgttaattgccgcaatgtaataagcgagtaagacaatttcattggcgtgaatttcattatatttttgtggtaatttttcaggcggaataatcccgctttgcaataatcgggtaatgaatgttcctgttcccgtaaatgggtctaaaatttgtacacctttatcggcaaggctagcgttaaattcattttgtagcacatcttccaccgagtggataataaaatctaccacttgaattggggtgtacacaatacctaatttatcttttaatttcttaaatgcttgagcaaagaaattatcatataaatctttgatgatagattgtcgtccttctggacttttgatattgctaatgcgttgctgaatactctcgtagaactcttgtaactgtttggtttctgcattggcgatattttcgccttgtaaaatagtaatagtttcacttaatgctttagacattgggttgtgttcggtgaaattatcgttagcaaataaggcatcaaaaactggtttggtaattaaatgctgagctaacatttcaatcacttcatcatcactaatcgcattatttaaatcatcacgcaattctgccgcaaaggcgttgaaagcggtgatttggtgtttattgttagggttttccaaaatcgctttaatccggtctatatgagtttgagcaatttttgccacatctgccgcccattcttcccagtgcatacgatttccacattttttcacgattttggtaactaatgcacgctcaatttcgccaatttcaaactcaaattcttcttgaattgggaaattagctcccgtgccttttgcaccgatattgtgctgatctcgccccgatttttcatattttttctttttcttgttttgatcttttggctgctttttcaaaatttgcgagatggtagaaatgacttcgattttatctttggctgcaccatcaaactgcattttgttgatcattgcatcaaaacggtcatcgtgagaacgcagagcattaagcacttgccatactactttatagttttcattattatctaaggcttcttctggcgttttcccagcaggaatcactacaggcaaaatgacataacctcgctttttgccttctgctttccgcattactcgccctaccgattgcactacgtcaatttgtgagtttcttgcagttaagaataacacggcatcaagggctggtacgtccacaccttcggataaacagcggacatttgagagaatgcggcaggtgttatattccgtttccgatttcaaccagccgattttgcctgttttttcactagcattcattgagccgtctacgtgttccgcttcacattttagttgtagcgattggttgagatcataaggtaagccctgttcttccaatgatgcaatttcttgttcttgataggcttcaactaccgtcgagaacatctctgcaatcgctttggaactcactttgtgtttattacctctgtaatttttctcaatcacttggcaaaatgctaccgcacgtttcatgggttgataatcatcggcaagatcttcttccacaccatattttgataatgctttccaacagccaacgatttttgccgcatcgtccacttggatttcattaccttctgcattcaaaagattctgcaaacggcggttaatatgcgcctcttcaacggcaagtaccaacactttataatcgactaataagccttttttcactgcggtagaaaagctgattgtaaatagttcttcgccaaaaagtgttttatcgtccattgaataaacttccaccccttcagattttttggcatcttcggtatagatgcgtggggtggcagtcatataaagacgtttttttgcttggatataatcattattgtgaatgcgaacaaatgccgattctcgctcatcgtcaaaggtatgtcctgtagtgcggtgggcttcatcacaaatgataagatcaaaactatttaagcctaatttttgagcctgatggataacatcaattgagtggtaggtagaaaagatcacggtcattgcttcattggcatttttgcattttataccccgaattaaaccgcttgcatcggttgtggcagggtaggaaagctcgtgtaatttagtttgaactaaatcatcgttagattgtttgccgacatcactatcggaacagaccgcaaagctgtgcagttttacaccgctttcttgtgtccattcagttaaagtttgagaaagtagtgcaagacttggtacgagaaacagtacgcttttcccttgtccagccattgcttcggcaattttgagtgaagaaaaggttttaccagtaccgcaagccataattagcttaccacgatcggcagtttctaaacctcttttaactgcttttagtgcttgaatttggtgttctcttaattcctttttagcacgcaatacaaccggttgttttggcacatatttttgccaatcgatcacactttcttcaaaattggaacggttgataatattgactggaataagttgatcagcaagggatttttctgcattttcagaccaatggtttgtcgtggtaacaattaaacgatgtgtaaaatcttttttacccgatgcagtgaaaaagctatcaatatcgcttttttgaatgcggtaatcggcagaatagtttttgcattgaatagcggtaaatgtgctatcaaaaccaacagcgactaagtcgatacctgtatcatttttatttgtgccttctggttgatatttttctacccaatcagcaaaggtgagaatttcttgatagagattcgtatattgcggttcgttggtgagatagtgttgagttaaggtttcaaaataagtgcctttttcacgctgggtttgcgaattttcttgcaggcagattaaaagttgagaaaatgctgattgattgattgattgattgattgattgattgattgattgattgattgattgattgattgattgattgattgattgattgattgattgattgattgattagacatcatattttccttttatcattgtatcaacacgctgaatttgatctgataaaggatagcaggttagtttaagttgagctagtaagagcgggtaaatttacccgcttttttttgctttttggttaagtgaagaataaaaactcaaatagaataatcgctattttgtcttaatagcattgagttagatccccctttaatgtaaactattgtcccgtctttatgggaagttgtttgttgtcaaagcaaattctccaacacttattttcatatcaaaaacacataggtttaatatggctaccaattatatttttgtaaccggcggcgttgtatcttctttgggaaaaggaattgcagcggcatctttagctgcgattttagaagctcgtggcttaaatgtaactattatgaaactcgatccttatattaatgtagatccggggacaatgagtccgacacaacatggtgaagtttttgttactcaagacggtgctgaaacagatcttgatttagggcattatgagcgttttatccgcactaaaatgactaagcgtaataactttacaacaggaaaaatttattcagaagttttgcgtaaagaacgtcgtggtgattatttgggggcaactattcaagttattccgcatattactaatgaaattaaatctcgtgtcattgatggtgcggcgggatatgatgttgccattgttgaagtgggtggaaccgttggtgatattgaatcgttgccatttttagaggcattacgccagttagccgtccaagttgggcgtgaacggactatttttatgcatctaactttggtaccttatattccaactgccggagaggtaaaaaccaaaccgacacaacattccgttaaagaattactctcaattggtattcagcctgatgtattaatttgtcgttcagatcgcatgattccacctaatgagcgtgcgaaaattgctcttttctgtaatgtaccggaaagagcggttatttctttaaaagatgtatcatctatttatcaaattccggctttattaaaatcacaagggttagatgattttatttgccaacgtttccgtcttgattgtcaagaagcggatttatctgaatgggaaaaagtgctttatcaagaagcaaatccgacaggtgaagtcactattggcatggtaggtaagtacacggaattacctgatgcttataaatctgttaatgaagccttgaaacatgcgggattgaccaatcgtttaaccgttaatattaaatacattgattcgcaagatgtagaaacaaaaggcatagatattttaaaagatctggatggtattttaattcccggtggctttggctatcgtggtgtagagggcaaaatcttaacagcacaatatgctcgtgaaaacaacgtaccttatttaggaatttgtttaggtatgcaagtggcgtttattgaatatgcacgtcatgttgccggactaaaaggtgcaaattcttccgaatttgaccgcacttgtgaatatccagtcattgcgttaattactgaatggcaagatgcagaaggtaatgtggaagtgcgttctgatgaaagcgatttaggtgggacaatgcggttaggtgcacagcaatgtcatttagtcgaaggaagtttagcatatcaattatacggttcggatattattgaggagcgtcatcgtcatcgttatgaagtgaataacgttattcgtccgcaagttgagaaagcaggactgaaagtaacaggcttaagtgcggataaaaaattggtagaaattatcgaagtaccaaatcatccttggtttgttgcttgtcaatttcatccggagtttacttcaacaccacgtgatggacatccgctatttgcaggctttgtaaaagccgcaagcgaaaaccggaaaaaataaacgtgcagaaaataaaaatagcttgggaaatccaagctatttttttcttattgatatagttccgacacaagttgaggagagagcaatctttctttttcatggaacaaggttcccatgtagtaagaaccgaacggagtgaaatgatcttgatcgccataaatagatttatttcctacataaactgtatcacctaaatattttgccgcatcaacccatgtaacattcggaatgtttttaattaattggaagatttcattgttgcttgcggtattgtccgccaatttttggatcggatttaaatatttatctaagtcatattttgctaagaatgcatttctaagagcggaacgatttaacgagatattattcgcaaacacatagactttttttgtttttgccagatgtttaaccatcgcttgaaatttttgatcaaaatcagaaattacaaaggaattaggattgaatctcggtacaggtataccgcctctttttaactcataaaacatggaaataaaaatgacaggataagattcaattttttgccaatattgtgcacaatctttatcctcaaatgagaggcgatcacgaatgtttaagatatccgaacgccacccttcttttgaaccgacataatttaaaaaatcttctagatgccctgcatgcgaatcacctatggttaaaattttacttggaatattgagaggcaatacttcttgttccgctttctgagcttgtaaagcagaagttttatgctttatatgagaacgtacacttaaattgtagccgatgacaactaatgatgggattaaatataataggaaaaaagactgtttaaaggttaatttagattttctaataggttgttccaataaataataacttaatgccgaacaaataaaagtgagtacgatgattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttagaggggaatatagacaatccatttattcttaaattgtcatctattaaattgtctaaggttggatattttatatcgttagttctaattccatgctctttcatatccgcatttattgcgtcaaataatgcgtttctgctttgatagtcttgatagtttttaaacactagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatttacaaaggtttatttaatgaatttgaaagagtgggaaagaatggaaaatcggatttggtgccagtggtcggactcgaaccgacacgcttttaagggcggcggattttgaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaaaataaacgttgaaagttattagctgcaataaagtaataactttgttctgtcgcttcaatttcggtaattatttcctgtttcagtaaaatatgagcaataccgttaaaaaattgatgcaataaaaatgatacaaaacctgttgtttcaacttttacagggcgacaataaaagtacttgtcataccaaattttaatgtcatcttttaattgttgagagctcacaatttcatgtacaacagcagagatattaactaaattaccgttgtgattcagccaaatcgtataacgattccaatccccttttctcaatggttctgtgcagatacaaaaaagatattggtaggcttgattatctagattacgattatcccagatgtatttcagtaaacctaaatcgtgtttcataatgtttctccaaaagaaaaaagtggggaagcattttacctatagggaaaatatttccccatagggtaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaatctctcaagtcaaacttgaaatggatatgcaaaaaatgctcaccagtaatacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctcgataacggggataaagttcgctattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattcccaccattcgaccattgagagtaatttcgccgcctctttcggaaaatcctccatattttgcgtagcaagccacaaccaaattccaagttttcgccacatttttgaccctttcaccaagaatttggcaagtagaggattgacagtaataatgtgagactcatcagtaatattgacaatagggcgaaaactgtgttggtatttttctccaagactgttgatatggttgattaaggaaatataggcaatggaaagttctgcttcatagccttcacgagcaaacatggctaaatctactaaggtaatatctgcctccggccaaatttccccttcacggttaaaaaacttcccattgattccggtacaaaacatttccatcgcttccgccatttctgctaaacgggtacgccgttcttcacgagtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatagtacttcgtgtagtaatgtgatttggcatccatctgcggattaaaattcattggtagccaacgcaaatagctgttaagtggggcaatttctgcattttccttcacgggttctaggttgttactgagcagaatcgttctcaactggcgagaacgggtacgtagctccttttcatccttacctcgaacgtaaaatgcaatagctgcttnnnnnnnnnnnnnnnnnnnnnnnnnnnnnnnnnntacagtttgacagtcttcttttaggtatttcgactcaaaattttcacctaccgctcgactactaattttttctaaatgtgcctccaacttatcctgtggatggatgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattcatcacccatcaattcattaaattcatcacaatgaagattaattttnnnnnnnnnnnnnnnnnnnnnnnnnnnnnnnnnnnnnnnnnnnnnnnnnnnnnnnttatataaatgacctgccattgagactaagtcagcaaacatactgtttcctacagcggccgcaactgtcgcatcagagagagcatctaaaccaatataaacgattcctcgtttacgaataatggattcccagtcaaaaataggacgttcatccaaaatatcagcataatccggggataacagctcagaaattttccctgtcgtcaatttttccaagagcggtaataacgacgccacaattttatcaaaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatcaatattttgtacaaactgggaaatttgaacatagtttgggcgatttcccaattcaactaatgcacgtgcgacgatattgacaaatcgccaagcnnnnnnnnnnnnnnnnnnnnnnnnncccgctccacttagctgtcctgaaatacgcccagcgacttccgaaatacgattaaagcgtcctactgggttataacgggcnnnnnnnnnnnnnnnnnnnnnnnnnnnnnnnnnnnnnnnnnnnnnnnnnnnngctcgttttgcctccgcatacattcgtttgagcatatcggcatcgcctttcggatcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaaactgcccaacaccggttgcccctgttggcgaaccttttccataccagccatcttccatcttcaccaaacctcttaacatctcctcactcacttgataatgttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactaataaacgagtgattgccattgtccatcctgttgaatttggaacgcagcaggcattttgcctaacgcatatctcagccaatagccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcaccatcaattttaatcattttgatattgatcaagcgacctttcaatgctacacctgtatcgcctttcttgtgatttttaccctctttttgataggtaaaagtatcaaaccaaaggtctgacattacaaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagaatagaaaggtgttccttttttcggctcaactaaacggatattgtttaaataacctaagccggttgtgtgaaggttaaaaaagtttttttgtgctgaagtttgagttgacatagtttgtttctccaaatgtaaaaaagcggagaaacatccttacccaatacgggaaaaatgtttcccgcaaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcggcaatttgatttaatgcttgttcccataatgccgttaaccccggatttttcagtaagtccggtaaactatcaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggataatcccatggtgagcggtaatttttttatcattccacgcacgggatttttggctcaaattnnnnnnnnnnnnnnnnnnnnnnnnnnnnnnnnnnnnnnnnnnnnnnnnnnnnnnnnnnnnnnnnnnnnnnnnnaattgtgattctggcagataaccacagtctgtacggggataagtcgtgattttatgctcttcgtaaagggattgtgcgatatccaacacctgctgagccccaaagccaaacaagcggttacattcgccttgtaaatcacttaatgcgtagagtaacggtggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcattttttgcaaaagtgcgtttaaaatctacttaaaactctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcagcctgaaaactgatgagcgttttcaggctggtttttttgccgagcgttcaaggataactttggtacacgctgtgcgtgccgtttttgcccagcagcagcacatcgtaggggtcttttcggccgccgtacgcttcaccgtccattcccggcgagccaatgggcnnnnnnnnnnnnnnnnnnnnnnnnnnnnnnnnnnnnnnnnnnnnnnnnnnnnnnnnnnnnnnnnnnnnnnnnnnnnnnncgacggcgtagccgtcaatcacggcggtgtggcaggagccgtatttgggcgatatgcccatttgtgtgcggatttggctgttgccggtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtataacgatcttgcccattttgatcttgccatttacgggtttttagacttccttcaacatagactttcgagcctttgcgtaggtactgaccacaaatttcagcttgacgacgataaaacacaatccgatgccattccgttaattcacgactctctcctgtcgttttatctgtccaactttcgctggttgctacactaatattggaaaccgcttcgccatttggcattgttctcacttctggatcgttgccaagattcccgacaataatcactttattaataccggccatcgtatttactccttcaacgaattaaattaggtttattaaacttgattcaggttaagaaaaaatcatttaattaaaattctgttggaatgaatttnnnnnnnnnnnnnnnnnnnnnnnnnnnnnnnnnnnnnnaaaggctttttcttcgttaaggtaaggggcttgtccccttacctttaaaaggccttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatggaccaaaattttggatctttggtctcggtaaagagctccttgagtgcctgaatacgagtattaccaccgtcagcgataatatagaaatcttctcccggacgacgggtgatattcggcttatgatctaaccctcgacgacgaatagactctttgatcatctcaaagttaggnttacgggttttncgaggnttatgctcatanggacgnaanttatccancgttacngtaatntattcaacatcgctactgtaatgcgttggtgtggctgtttggtaggatggagccgtatttgaaataggtgaaacatttaatccttttgctatcgctgccagtcttttttcatcttttgtcataatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatagacttcatcacgatagataaacaaaatcacatcagcatcttgctcaagtgagcccgattcacgtaaatccgcattgacagggcgtttattggtacgttgttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngattttgaatccgctacgtctaccaatttcgtcacactggctgtgtgctttattgctcgacattatacgtttataaacttaccttgcaagcagtaatttaatattttggtttatttgttttaattttcaacaaagttacctcaaccgcactttacaaaaatattttatagtaaagtgcggttgtttttttactctctttttctattaagaagccaccaaatgagaataataaaaagtaggcttggaatgagagctgaaaatgcaaccggtatatcatacagaaggcttaatcgcccaaaaatttcattgatgacgtaaaagagaaaaccaaagaaaataccggttaaaattcttgcaccagctgtaacattgcgtaaagatccgaaaataaaagaaagtgccaacaacatcatcaccgcaacagagaccggttgaaagactttttgccaaaaagtaagttcaaaacgtttagcatcttgtcccgtttctttcatgaatttaatatagttgtataatccagtcatagacaacgacgttggacgcaaagaagctatccccagcttatcgggtgttaacgttgtactccaattatctttcaagcgattaatcgttttaatttcatcagcaaaaatttgtgattgattaattccgcttaatttccatttgccatgttcaaaacttgcttggttcgcatgtgtaacttgtttcaattgacgcttatcatcaaaactataaatataaatatcattcaacctaatatcattagtaatacgaccaacatagataaaatcattaccatcttttgcccaaatactattttttactgaaagcatggagcctccggaaattgcttttgcacgcatatctctggcaaagtgttccgtctgtggaataccccattcgccaataatcattgtgataagcatcaatggcaatgcggttttcatcacggctaaaccgattctaaagcgagaaaatccagcagattgaatcacaataagttcactacgacttgcaaggttaccaagtgcaataagtgatcctaataatgcagccataggaaaaaatgtttctatatcttttggcatagttaataaagtaaacagtgttgcctgaataacatcgtaagttccttttccaatactacgaaattgttcaacaaatttaataatcgctgataaacccaccaacatcagcaatgtcgccaaaatagcacctaaaatattttttccaatatagcggtctaaggtattcatcatcattattcctgattaccttttacttgaattaaagttaaataaataacgtattttatacataaaaacactattccaactgttcaataaaacagctaaaaataaaaagaaaatactgactaacggcataaaaatatgtgcttcaattttaccggaagcccccgctgattttaatgaactttgtaacaagaaataaattaaatacaataaaagtgcgggcaaaatcttagcaaaccgcccttgtctcggattgactcggctgagcggtactgcaataagtgccataatcggaacagcaaaaattaaggtcaaacgccaatgcaattccgccttagctgcaggtgatttagaattaattaattcctttaggcttaaaatttccgtttcagatgtatccttatctgttgtcttataatctaaataggcttgatactggtcaaaatgcgtaatacgaaagtcaggtaaaagtgcggttccttcaactcgctgactattttctagactaagaacttgatcgccattgggtaacgccttcaactgaccggtttcagctaccgttacggaaggcttctgattttttttattttccatttggaaaacataaatatcttgaatttgattgttttttatttcattgataaatagcacaacatcagtatttccgacattaacaaattgtcccgacgctaaagcccccattgttggatttgcttttgcatcatcaataagttgaatttgtttttgcattgcccaaggggacagataaaacacattataggttgccaatcctgctgtcaataaagataaaattaacgcaacaccaacaagaatacgctgaccaacaccacaagcccgcatgacggtaatttcgctttctgcatataaacgtccaaatgtcagcaatatagcaataaataagcaaaggggaaatataagttgtgccatcgtcggcatacccaagctaagcaaagcaaaaaccaaatcagccggaattttaccaacagatgcagaacctaatacacgcacaagttgttgactaaaaaaaagcagtaaaagaatagataagattgcaatttggcttctaaaaacttctttggttaaatatcgaattaatatcactgaattacctatatttctcttgcaattttaaaaaaaagcagtaatttacgaaatcacatacatggcgatgtatgataacgtatttttttattgaaaacagtaaattcgtgaggattacatgaaatatagtgcaaaaaataccgcactttctcaaattgacagcaacattattttagccgtatttgagggcggaaaactttctccgacagcaatgcaatttgatcaactcagtcaaggctacctaactcgcttaattcaagtaggtgaagttagcggaaaacagggacaagttcttattttacgggatataccgaattgccaagcacaacgtatttttatcgtagggtgcggtaaaaaagataaaataacagaacgtcaatataaacagattattcaaaaaacaattcaaacgattcttgagactcaagcaagtgaagttgtgagctttctaaatgaaattgaactaaaaaatcgtgatattcattggaatattcgttttgcaattgaaactattgaagcaagtttttatcaatttgatgctttcaaaactaaaaaaggcgacgaaaattcagtattaaatgaatttatttttgatgttcaaaccgaattacaacaagatgcactactggcgattacttacgcacaagctattgcattaggagtcaaacatgcaaaagatattgccaattgcccgcctaatatttgcaacccaacttatcttgccgaacaagcacaatccctcgctaaacactcaaacttgattaacgtgcaagttttgggtgaaaaagaaatggcagaattgaacatgttctcgtatttagctgtttcgcaaggaagtgctaacgaagcaaaaatgtcggtgattgaatatcgtaatcaccccaataaaaatgccaaacctattgttttagttggaaaaggtttaacctttgatgccggcggtatttcattaaaacccgctgatagcatggacgagatgaaatatgatatgtgcggtgcggcttctgtatttggtgttatgtacgctctggcaacattacaattacccttaaatgtaattggtgtattggctggttgtgagaatttgccggacggaaattcatatcgaccgggagatattttaaccactatgtcaggattaaccgtcgaagttttaaatactgatgcggaaggacgtttagttttatgtgacgcactcacttatgttgagcggtttaaccctgagttggtcattgatgtagcaacactaacaggtgcttgtgtagtggcattaggtcaacataacagtggcttaatcgcaacagatgaaaaacttgctgaaaaattattaaatgcggcagaagaaacgaccgataaagcttggcgtttacctttaagcgaagagtatcaggaacagttaaaatctaattttgctgatttagctaatattggtggacgttggggtggagccattaccgccggtgcatttttagctaactttacgaaaaattatccttgggctcatttagatattgcaggaactgcctggttacaaggtacaaacaaaggtgcaacgggacgaccggtaagtttactaacgcaattcttaattaatcaatctaaataactgcaaaagtgagagtttctcttttagaatatgagtatcaaaattcaatctaaacaaaaggagactctcattttttattccactgatccatttggctgagatttccaccgcacttaccttctatctatcgccatcattacttaactaatacaactaatccagaattttattaaactttgatctataaaatttcagtataaaagatgattttatgaatgaaatgagctaaagtagccgagttttgtagcaaggatgatttttaaggatacctcatgaaacaatctctgcgtcataaaaagataattgaattaataaaacagaaaggctatttgagtacagaggaattggttaacattcttaacgttagccctcaaactattaggcgagatttaaatgaattggctgaaaataatctgattacacgtcatcacggtggagctacttcactttcaacatcagagaacagtgattatagtgaacgtcaacatttcttctcgtctgaaaaacggcgtattggtcaagaggtggcaaaaattattcctaacggttcatctttattcattgatattggtacaacaccggaagctgttgctaaagcattattggatcatcaaaacttaagaattgttacaaataatcttaacgcagcctatattttgatgcaaaacaaaacatttgatattacgatggctagcggatctttgcgtcaagatggtggtattattggtgaagcgacaattgcatttatcggacaattccgtttggatttcggaatattaggtatcagcagtattgatttggacggttctttattggattacgattatcatgaagtgcaagtgaaacgtgcaattatggaaagctcaagaaatactattttagtaacagatcattccaaatttactcgccgagcaatggtatatttaggttcgttaacagaagtagactatttgtttacagacaccacaccacctgactccatgcttagccttattaattcaagcaatgtaaaactgcatatttgtcaatagaaattttatcaatagagatgtgtagaagattttatcttctacacaataatcaatttaatgccctcgccaataaactgatagggtgtaaacaagaagcacttgttgacatatcaatttgccatttgcaagtttcacattcagtgatgacataatcgaaacaaccttgttcaataacctcaaataaactttttccgatggcctgtgaagtctgatagttttcagatttaaagccatatgttccagcaataccgcaacattgagacggtaaaatagtaacatcaagatccggtatttgtttaagcaatgccaacgtataaggtgcccaccccgctttttctacatggcaggcggtatgataggcaactttaagaggtgtagacttaaagtgcggtatttttccatcaagatatagtcggtaaagatatttggttgcaatattgacatgaggacgaattctcgcattatccatccccaaaatatgatgatattcatcacgtaagttcattgtacaacttgaagatgtaccaataatatccaatgctttttcttgaatcacccgttcaatttgtttaatgttaaactctgcttgttttttagccttttcaggaaaaccgttcaccatgagcggcaaaccgcaacatttttctttttcaagcaaaatcacgccaatatcaatcgaattaagtactttaatgagatctttgccaagttgaggataattataatttacataacaaccgtgataatacactatcttatcccgaaaatagatctgacggtcaagagcatattttttataccattgacggaacgaaccgaatgaatattttggtaaagtgcggtgcttactgaccttaagggttttatctaaaacatatcgggttgcttttaatccagtaatcgcatttacaattggagcaaaaggcgtattcattttacccatgatatccgtattacttaatacagcatcacgtaatttatgtattggtgatttatgttgttggtcaagatatttatttctagcacgaatgataatatcaccaattttaacgtctgacggacaagcaacctcacaacgtttacaattgatacaatattttaatgcttcatcataaagtgcggcactttttaagcgtaaccgttcaccgtccggtcccgcctgtttaggtccgggataaaaaggattttgacgagaaacagggcaaaccacagtacaagcagtacattttatacagctctcaaaactttcatcggtatggtgctgagtaataggaaaagcagcatgttgttttgcattttcaatgagttgttgaatattcatattttgccccttatactcgattttgtgcttcgataatgttatcggcaactgttagtgcagtaacaactgccactccggaaccacaccctagttccaatgcattgtatccgccaataacatttccagcagcatataaatttttaataatctgaccgctcttttttaattggcaacggctgttaattgcaacgcccgcagactgataaggctgaggtgaagaaaaacgccgagcagtccaagtgagtctgttttgtatatcaatcattgaattgccaatcatgtccacgtcaaatataggttcaagtaaacgatcaaaaacactcaccaaaccattactgaaaaaactgccggaagcaagaacaaaatgttctgcgaaaataccatgttcttgatgtaattgagtgtaaatttgtttaacctgttgatcctcaataacggcacgcaatgctttatcaccatttaaaataaaaccgcccagtttttcaaaatacgtttttaattttttatgttgacgcaatcccactaatgaaggcggtaatgtaggcaattcgtataaatttaatccagtttccaactttaatttattgaaaaagtcttggttatctaaaccgaaacacgccggtaaaaagacggcttccgcacctccggacgcttgctttatttcttgtaccaattcacgaaatgccaaacggtgttcaagtaattgagaaatattgacactgcgaaactcacgagaagttaaacgcaattgatccaactcaggaagatgtaaaagtgcggttgttattgaacaatgtttaaattgcggatgttgtattaaattttcagccaataagtgcggttgaaaatcatgataaccttcaattcccaatacagtaattttttggtatccaaaatgttcatcatgaagatccattgttggaatacaatcagcggacagccaagtgcggtgtaatccgcccaacggtgtaacacgaaaatgattttgcttatagcttcccgtcacattgagattaattttttctattaattgttcaaattgcttggctttttgtaaaacatgttgtttaccaaataaacagtacggatgatttggaagttgttcttcaaggctgtcataaccttgttcaaaagaatttatcttttcaccgtttggtaattggcttaaaagatccattgaacctgatgaaaaattcatggctgattgaccattattaataatcgcacaacatttccctttttgttgaagcataattccgcaagttaaccccgcaagcccgcctccgataatcactacatcaaatttcattgccatctgttccttgctgtgcttgttcagttaaagattgaacactatttaagcctaataaactgtaatatatccaactggaaaattccgcttcacggattgcttcgccccaagcaatcggttcaatacctcgccaacgttcttccataaaagatgataattgcagtgtagattgtctaggtgttgccatatgaaaacgtgccattaatcctgccgcacggcaagcacaaagttcagcctggcaagttcccatgcccacacgtgtacgacgacgtaaatcaacaagattattgacttttaattcttctacagcataacgtacttcaccggcagtcaccgcttcacattcacaaacaagtgtacaatctgaccgctcttttccaatcaaacgagaagcccgttgcccatgacgataacgtgcggaaatttgaagaggtgttggtaacgatatgattttattaatatgaggaacattttgatcagattcagaacctggaagtaattcttgggcagttgtacaaacagtttgtttgccaagttttttactaactaaatcagttgcccattccgccatcaaacgataagtcattaacttacctcccgtaatagtgacaaaaccttcaagaccatcacggcttgcatggtcaagcaatacaataccacgactaacattacgtcctgatggatcatcatcactcgctactagaggacgaacacctgcataggcacgaagtactctagtatgacgtaaactcggtgcaagtttttcgccttctctaaataaaatatccacctcttcgggagtaacaatcatattatcaatttgatcataagggatacgatctgatgtggtgccgataacacagatagtatcgccaggaactaaaatatccgcatcagctggtttgcgacatcgattaattaccaaattattaatgcggtgccccatgacaagtaatgcacctttagcaggaaacatcttgactttgagatcggcatattcagcaatcccctgtccccaaattcctcccgcattaacaataacctgagcaaaaaaacggcgatttattttatttttgtgatcatatacttctgtaccaatcactcttccgccttcacgaatcagttgagtaactgcacaataggtaaaaattttagctccatgctcacgtgcatccaacatattggcagaggttaaacgaaacggatcaattgaaccatcgggaacaacaaccgcacctataagctccgggtttactgaaggctccattattctggcaaggtcaggctcaatcggtactgcttcaatacctgcttttgtacaggattgaataaatatcttttgataattaagatcgtcttcaggtaacgtaatgaaaagccctttggtatcttcaacacaatgacgtgcaatacgttttaagatcttattttctaagatacattcctctgccgattcatgatcattaacagcgtatcttgcaccgctatgcaataaaccatgattacgtcctgttgcacctgtggcaatgtcataacgctctaataatatgcagtcaatcccacgtagtgcacagtctcgtgcaataccggctcctgttgccccaccgccgataataatgacatcagcactgagcggtggaaaatctttagaaaatttttgagacgacattgacataatcatcccccacattgaatgtaaaaaattactattagaaagtgattatataatacgttaaatgttcgttttagaaaataaaatgagtgatttcttatcaaataatgtgattaagatcactttattagtttcgatttgaattttttttgtgtttttttgtgatttacatcacaacataaattaaattagctttttagatttcactttttggttattatatgagtgaacgttcaaaaaagtgcatttatcggtcctaattttttatacataagattggtttgataattgctatattttaatctaactaaactactggagatttattatgtttggtccatttaagcccgcaccgtatattgaggagctatcaaaagatagaatcgatccaacttatagacggttgcgttggcaagtattcatgggaatatttttcggttatgcggcttattatttcgttcgtgctaactttgacctagctcaaaaagggttaattgaagccggtttatacaataaagcggagttgggaattatcggtacgggagcaggtttggcatatggattgtcaaaatttgtgatggcaggtatatctgatcgctcaaatccgaaagttttcttgcctttcggtttattattgtcagggttatgtatgacaatgatgggcttaatgccttgggcaacctccggtattgctgttatgtttgtgatgatattcttaaatggctggtttcagggaatgggatggcctccatgtggtcgtacaatggttcactggtggtctaaatccgaacgtggaacaatcgtttctatttggaactgtgcacataatatcggaggtatggtaccgggattaatggtattgttggcaagtgcgatttatttcagcgagtttggagtacaggcaactgcaaaagatatttggcaacaagcgttatattatccgggtattgccgctatgatttgtgcaattccggtctattttgtgatgaaagatacaccacagtcttgcggattacctgcaattgaaaaatggcgtaatgattatcctgatgactataatgaaaaaacctatgaaaacaatttaacaacaaaagagatctttgttacttatgttctaaaaaacaaattgttgtggtatatcgctattgcaaacgtatttgtgtacctcattcgttatggagtgttgaaatggtcccctgtatatttaggagaagtaaaacattttaatattaagggtactgcttgggcatacactatttatgaattagctgcggtaccgggtacattattatgtggttgggtttccgacaaagtatttaaaggtaaacgtggtttaaccggtttcattttcatgattttgactactattgcagtggtagcattatggatgaacccagcaacaccagaacatgaattagcacagtatgcaggaaaagcgtggtatcaaaatccatatcaattaactgacttcattttaatgacaacagttgggttcttaatttacggaccggtaatgttgatcggattacatgcacttgaacttgcaccgaaaaaagcagcaggcacatcagcaggtttcacagggttattcggttatctcggtggtacagtatccgcttcagccgttgtaggttgggctgcagaatactacggctgggacggtggcttctacgtcatgataaccggtggtattttagccatcctgttaatgtttatcaccatgatagaagaaggtaaacataaagcaaaactagacgatcattacggtaaataatcgttaaaaaggaaagacaggaaactgtccttcctttttctttattaggtttatgtattcaaattttaaccacatttttatcacagattttacttctacttaaggaaaatacaatgaaattagctacccctctttgtgcaattactttagtagctgcaacactatcaggttgttctgcacaatttgaaaacaacgttaaccaaaaagataaaattatcattgctcaccgtggagcaagcggttatttacctgagcatacgttagaaagtaaagcacttgcttttggccaacacgctgattatctagaacaagatcttgcaatgaccaaagataatcatctcatcgtcattcatgatcattttttagatggtttaacagatgtggcgaaaaagtttccacatcgtcatagaaaagatggacgttattatgtagtagattttacgctgaaagaaattcaatcattagaaatgacggaaaattttagtctgaaagacggaaaacaggttcaggtttacccaaatagattcccgctttggcaatctcatttccgtattcatacttttgaagatgaattagaatttattcaaggtcttgaaaaatcaactggtcaaaaaatcggtatctatcccgaaattaaagcaccttggctacatcaccaagaaggcaaagatattgctttagcaacattaaaagttttgaaaaaatacggttatacgaaaaaagatgacttagtctatttacaaacttttgattttaatgagctaaaacgaattaaaacagaattgttgcctaaactaggtatggatgtaaaacttgttcaattagtggcttattctgattggggtgaaacacaagaaaaaaatgctcaaggcaagtgggttaattacgattatgattggatgtttaaaccggatgcggtagaaaaaattgcaaaatatgctgatggtataggccctggctggtacatgatgatcgatcaagaaaaatctaaaccgaatgccgtcgcttatactccattagcagaagaattggcaaaatataaattagaggtacatccttataccgttcgcaaagatgctttacctgacttttttgataatgtagatcaaatgtatgatgctctatttaaaggcggtgcaacgggagtatttactgatttccctgatacaggtgtaaattacttaaaaacccataaataattcgacattaatatctgtcattcttttaaacgaatgacagatttttgttcttgttgtaaatagccatttctccattatcctagcctttcaacctcaaccttcccctacgatatttcgtgcgtaaaagtgcggttattttatccggtgtttttattgcaatagaattagcaatctgtaatgagttatgaatagaatttgcatgggtaatggcaattgccaacgcatctgctgcatcaacctgcggtttatcggaaagttgtaataaccgaaccaccatttcctgtacttgtgatttttcagccgcacctgttccaacgaccgtttgtttaatcgttctaggtgaatattcaaatacgggtaaattttgattgactgcggcaactatcgctgttcctcttgcttgccccaattttagagcagaatcaggatttttcgccataaaaacctgttcaatagcaaattcattgggattgaattgcgtaataatttctgttattccggcataaattcgttttaatctagttggtaaatcatctattgaggtacgaataacaccactgcccaaatattctagcttatgcccaacttgacgaacaacaccatatccggttactcgagatcccggatctattcctaaaataatagacatcctattttccaaaaaataaatgaacctcatttgagatccatttaatatagactaaaaattattttccaagtttaagagattgagctgatgaaacgtttttcatcatgcctctcaactaatttcataaatgttcctgatagaaaaaatgaagctaacttttaaagtaaagcggcaacctcatcacttatctcgccattatgataaacgttttgtacatcatcacaatcttccagcatatcgatcagtcttaacaatttaggtgcggtttctgcatccaaatcaaccattgtggaaggtatcattgttacttcagcattaacaactttaaatccggctacttcaataccgtctttcactaagcctaaatcttcccatgctgtgtaaatttcaacactaccgtcttcttgtacttgaatatcatcagcacccgcttcaatggctgcctctgtcaaggcatcctcgtcagcagactcaactaaaattagcccttttttactaaataaataccctactgagccttctgttcccaaattaccaccgcactttgtaaaacttggtcgtacttgagaaatggtgcggttagcattatcgctgagacactcaaccatcaccgcagtcccgcccggaccatagccctcataaattctagtttccatattggtgccatcaccaccgcctacaccacgctcaatagcacggttgatagtatctcgtgtcatattgttagataaagctttatctactgcggcacgtaaacgagggttagcaccaacatctccgccacctaattttgccgctgttactaattcacgaattaatttagtaaaaattttaccacgttgtgcatcttgtgctgctttacgatgtttaatattggcccacttactatgtcctgccattttatattccttttatgattgtacttttatattcattaatcgcctctgcattgttgggcgatttagtcaatttaattgcgtcctgtaccgaacaccattgataagctgaatgttcacttaaatttattactctttcatcagctaacggcaacaaaaaccaatgctcaatgcagtgagttatatcaggtgcatatttatacctaaaatgcggaaaaatttcaaactctatctgtttatggcaattaaagagcggtaagttttccgcaagaatatctatgccggtttcttccctcacttctcggattgccgtttgaacaggtgtttcacctatttccatcgtaccggttacggattgccaaaattccgaatcgtcttgacgttgcaacattaaaacacggttggttttcttggcataaataacgaccaaaatactgttgggatttttatagttcatttggattaccttcttaaagtcatcatcactcacattaaccaaaataatgttaaatgaaaaaacaacaattgatctgccccaaaatctcttaataaatcaaaatattaaaacatcattaataattaagatagcatttcaaatttcgtatcattgctacatagtaccgacttttttagcaaatttttctacctttttcttttcttctaattctttttgttgttgctctgcacgtttacgacgaatttctttcggatccgccaataatgggcgataaatttcaatacgatcaccttcattcactatatccgttaattttgccgggcgactgaaaatgccgactttattttcacgtaaatcaatttccgtaaattcctgcaaaataccagattggaaaatggccgcttgaatgattgtccccttctcaacttgaagttttttcaaataatatttatgcggtaacgcataagtaatttctatattaatcaagataaacgtcctttgctcgttgtttaaacgcttcgatcattttcgttgtcaattgtgaaaaaatccgcccgaaagcaaaggcaataacagggttggaaaattcaaactccaattgcaacgcaatttcacaactttgctcatcaatttcacgaaaaacccatttaccctgcagatatttgaaaggtccggaagctaactgcatcgtaatctcttggttgggaattaattgatttttagtcgcaaaaacctgtttgataccggctgtgctaatggttaattctccgatcgtttcattgtctatcgactgcaatgctcttgccgcaatgcaatggggtaaaaattgtggataactttcgtaatcattaacaatatcgtacatttgtttagcactataagacactaaagctcgctgatttatacttggcataaaataagatgttgaacaaaaaatgttgcaattatagcggaaaagtgcggtagaaataagagacaaaatagaaaagaatgattcatacaacaagctgttaatgtcgttgctttctaattgagcataaattaattttccgctacaatagcccactatttttagcgaacaaaaataccaatgtcagaaattaaattaattgtgggtttaggtaatccgggcgataaatatgccgatactcgccataatgcaggtgaatggttaattgaacgtttggcaagacgctttaacttcaatctctctgttgaatccaaattttcaggaaaaacggcaagagcggtcattagtagtcaagaaatgcgttttcttgttcctaccacttttatgaatttaagtggcaaagcagtaagtgctttagctaatttttatcgtattccgccggaacaaattttagtgcttcatgatgaattggatttttccccgggcatcgctaaaattaagcaaggcggaggacatggcgggcataacggtttgaaagatattattgctcaactagcgaataataaaaatttctatcgattacgcataggtattggtcatccgggtgataaaaatttagttgcgtcttacgttcttaataagccatctcccacagatcggcaattaattaaccgctctttagaggaggcgacggattgtattgaaatcctcatgaaagagggaataactaaagcaacaaatagactgaatgcttttaaagcataaacaaaattcaccaatctttgggctgaaataactcttctactctactaataaaaaataggaaaatttatgggatttaaatgtggtattgtcggtttacctaatgtaggaaaatccactcttttcaatgcgttaactaaagcaggtatcgaagcggcaaactatccgttttgtactattgaaccgaatacgggcgttgtaccgatgcccgatcctcgtcttgatgcactggcagacattgttaagcctgagcgtatactaccgaccacaatggaatttgtggacattgcgggattagttgccggtgcaagcaaaggtgaaggtttagggaataaatttttggcaaatattcgggaaacggatgctatcggtcatgttgtgcgttgttttgaaaacgatgatattgttcatgtggcaggcaaaattgatccgttagatgatattgaaactatcaacaccgaattagcgttagccgatttagacagttgtgaacgagcaattcaacgtttacaaaagcgtgctaaaggtggcgataaagaggcaaaatttgagttgtcggtcatggaaaaaattctacctgtattggaaaatgcaggtatgatccgttctttggatttagataaagacgaattacatgcaattaaaagctacaacttcttaacgttaaagccaactatgtatattgctaatgtgaatgaagatggctttgaaaataatccatatctcgacaaagtgcgtgagtttgctacaaaagaaggttctgttgtggtaccagtttgtgctgcaattgaagcggaaattgctgaattggatgatgatgaaaaaactgattttttacaagatctcggtattgaagaacccggtttaaatcgtgttattcgtgcaggctatgcgttattaaatttacaaacctacttcaccgccggtgtaaaagaagtgcgagcttggacagtttctgtcggtgcaacagcaccaaaagcagctgccgttattcacacagattttgaaaaaggctttattcgagcagaagtcatcgcttatgatgattttattcaatataagggagaggcaggtgcaaaagaagccggtaaatggcgtttggaaggtaaagattatattgtgcaagatggcgacgtaatgcacttccgttttaatgtttaatattcataactaattttataccgcatttttcgatttgaataataaaagtgcggtattttttagagagaaagatgaaatatcactttatttcccggtgttccattaaagtttttaactgggagacgtttgttgatgttgaagatttagcagatgatcctgcgagaatacaataaccgaatgaatgatctttagtgtggcttgtgtcataataggcatcgttttttcagcaaagtagcggagaatgattacatgagaattttacatactatgttacgtgtgggcgatatggatcgctcgatccacttttatcaacaggtattaggcatgcgtttattgcgtacaagcgaaaacactgaatataaatattctttagcttttttaggctatgatgatgaagaaaactcatctgttattgagctaacttataactggggtgtaagtaaatatgaaatggggactgcttatggtcacattgctattggagttgaagatatttatgccacttgtaaagcggttaaagaagcaggtgggaaaattactcgtgagcctggtccagtaaaaggcggaaaaactgtcatcgcatttgtggaagatcctgatggctataaaattgagtttattgaaaataaaatggcacaagcagggctaggtaatcaataacctcaacaatttttatcctaaaaaatgggctttttatctgcctattttaagtgttacatttatctcattcttataaggcaatatttcgtgaccgcactttcagaacaagcagtggattataatttacttaaaaatcgctttcggggtttttttcccgtcattattgatgtggagacagcaggctttaatgctcaaacagatgccttgctggagctagctgcaatcacactgaaaatggatgaaaacggtctattagtaccagatgaaaaatgccattttcatattcaaccgttcgaaggggctaatattaatcctgaatcactcaaatttaatggtattgatatagacaatccgttgcgtggtgctatatcagaaaatgttgctatgagtgaattgtttaaaatggtgcgtcatgggcaaaaaaaggctgactgtcaacgttcagttatcgtggctcataatgcgacatttgatcaaagttttgttatggcagcggcagaacgtacgaaaataaaacgcaatccgtttcatcctttttcgatatttgataccgcaacgttaagcggttttatgttcggacaaacagtgttggtcaaaggttgtcaggttgccaatatttcttttgatggaaaaaaagcacattctgctttatatgatgcggaacgaacagctgaacttttttgttatatggtaaatcatttaaaaaaactgggcggttttccccatgtggcaataaactcataaaaaacggtgctaacaaagcaccgctcttttgcgttactcattattcaaattactgtacaacaatactccctaaacaaccttgatcagctaacactaaatcagatgaaccgaaaataaaagggaatttagtagaggacgcatgattaaattgcactaaaatttctaccttgccgtcaatccaaagactatctttccatgcaatatccgattgttctaccggctgatcatttatgcttttcatgacaaaacgagcaccttgaattttaaatccgacgggccttgaagaacttagaatccagcgttctatctgccctcttttggtactaatgtctattctattcggttcaaaccgttgttgattaatggttgcattgctcacatcaaaataaaactctctcgttttcatatttttctttgccaataaactaggtgcatcagtatgaaattgccaatgacttggattataaaatactgattgaaagccctctgttcttaactcaacaataacattatcaaccagcatatcagaactgaatattgtacctatcttattcaaaagatttcttttactaccggtaattaaggtagcatttccgccctcacttaagtcaaccaataattcaaccctttcactaggtgcaagagaaacttttttgacaatttttgtttgtggcaaataaccttgttctctggcaatcaagaaaaatgcccgatcatcatcaaatgttaaatcataagaacgagataaagaggcattcaacaaacgtaaacgtaccaatcctttaggtacattcaaataaggtgcttcaacaccattgaccaataaccgctcgcctagaaagtgcggttgattttgaaatacttgctctcccttagaatttaacagtacatcttgcaaaataagtggaatatcatcaacgccatatttttttggcagtttagattgatgagtatctttgtcatttataatccacatgccaactaagccacgatacgtttgatacgctgaattagctaaagtgcaggcatgataaaaacaagttgatgccggttgagtaataggtaaaattggagcccatccttcccctgccttcaatactcgcccaataccaccaattaattcactgtgtgcttgtaaaccttgtatattcatagcaactgcctgcgttaaattattacgataatttaacttcacaaaatcaccttgctcaactcttacggtaggacctaaatgatgcccattaaatccccaaacttccgttagctttttttctatgaatgaagtttgagcagcttgcatcgttaaaaatatcggtcgcccacgttttgcctccaataacggtggaataaataaaggcaaacggctagcagccattactgattgagggatacatgataaagaactggctaaaataccgcttttcaaaaaatcccgtcgagtcaaagatctcatattttaccttgctgcttatacagattgctgttgaatttctgcatcaagctctgcgatgcgttgttgcataatttgatgacaatattcagctaattcccgtacattatcctttgtgtagtttgatgtatctacaggagacatcatttcacaaatcactttaccattgtcccaccgatttaggtcaatgcgattatgggtggttgaacaaacgaccggaacaattggcacaccagcggtaattgccgcataaaaagcccccattttaaaaggtaataatccacgcccacgactacgtgtcccctcaggaaacatccaaactgacaaattatcttcatttatacgatgagcaagttggtttattgtattatgggctttggagcgattttctctgtctaacaaaatatttcccgttgcccaataaagaagaccaaaaaagggaatccaaaccaaacttttcttgcctacactgactgtacgagggcgaaccatagcagaaacagtcaccatatcataattattttggtgattaccaatatagatgcacctaccgatactatcgacattttcaggaaaacgatgttcaacttttaatccaaaaaaaggatataaacgcccaaaccagcgagccatcacacctacattacttggatttttaaaacgaataagtgaataaagagatcctactacacaaattaaaatactacagaagataacaacgatggctcttaataatatcaacataaatatacccctaaaaatttgtatacgccaagtataacgaaaatctaaaaataagtgtagaaaaccataaaaaagtgctaggctagcacaaatattttaggaatcttagtatgaaaaaaacattctttattgcagatttacatttgagtgaaaaccgaccgcatttgaccgaactctttgttcaatttatgcaaacgcaagcactacaagcagaaaaactttatattttaggtgatttatttgatttttggattggtgatgatgaacaatcagcattgatcgaaacagtacaacaacaaatattacaacttactcaaaaaggtatctcttgttattttattcatggaaaccgtgattttttactgggaaaaacctttgccaaaagttgtggaatggaattattaccaacttaccagctcattgatttatacggtgaaaaagtgctgatttgccatggtgatacgctatgtactgatgatcttgcttatcaacaatatcgcaaaaaagtacaacaaaaatggctacaatggttatttcttcgtttgcccttaaaagtgcggttaaacattgcagaaaaaattcgccaaaaaagcaaaacagataaaacacgtaaaagcgttgaaataatggatgtcaacaaagattttgtggaacagattatgcaacaatttcaagtcaaaacccttattcacggacatacgcacaagcagaatattcatcaaaatccaccgcactttactcgcatagttttaggtgattggggagcaacagcttctgttttagaggtttcagccaatgggtttcagtttatctaattcgtcaggcacaaaacctaaacataaagaaaaagagatcaaaatgtgctatttttccatcacaactaaattttttccaatttggctaaatgcgcgattagccatttaataccttgtccctgaaaagcgatttgtaatcgggtattattatcagccccctcaacattaatcactgttccctgaccaaatttttcatgtttcaccttttgtccaactttccaactattatccgataaatcagttttgacgatagaacccactgcacttcggttataagctcgagtcactgtgccacgtaaacgaacttcttgaatacattcttgcggtaattcagcaataaaacgagaaggaatatgtttttcgtctttaccatacaagcggcgaacttccgcataacacaatgtcaatttctgttttgctcgagtaatccctacataagctaaacggcgttcctcttccaaacgtgccaagtcttcacccgaacgaaaacttgggaaaagcccctcttccataccaacaataaatactcttggaaattctaagcctttcgctgaatgcaatgtcatcatttgcacacaaggctggtgagaggctgcttgttcttctcctgcttccaaagaggcatgtgttaaaaacgccactaaatcagacatatcttcagcctcatccggttttataaactctctcgttgcggtaaccaattcctccaaattttcaattcgcacttcccctttgtcccccttttcctgtttatacatatcatataaaccggaatgtttaatcacaaaatcagtttgtacaaataggggcatttctgcggtttcttgttgtaaggaattgattaattcaataaaacgtaacaaaacagttaccgaacggataggaattaaattttcttgaatggcaagctgagttgcttgccataaagtcacttgtctttcacgagttaaattacgcaaaatatctaaagtacgttcaccaatccctcttggcggtgtatttacaacacgttcaaaagccgcatcatcttgtcgattggcaattaaacgcaaatacgctaaagcatctttaatctcttgtcgttcaaaaaatcgcataccgccataaatgcgataaggaattttagctctgagaaatgcctcttctatcacacgagattggctattgctacgatataaaactgcacaatcatcaaccttaccgccgttatccagccaattttgtacctgaccggagacaaacaaagcctcatccaactcgttaaaagccgcataaatccccacaggttctcctttttcacccgcagtccaaagatccttacctaaccgattactattattggaaattaaacggtttgcactttctaaaatgttgccggttgaacgataattttgctctaaacgaataattttcgcttttgcaaaatctttaagaaaacgatgaatattctcaatttgagcaccacgccaaccatagatagattggtcatcatctccgacaatcattacattgccctgcgaaccggctaataatttaatccaagcatattgaattttattagtatcctgaaattcatcgatcaaaacgtgctgaaaacgctgttgataatattgcaaaatatgtggattttttagccacaattcataagctctcaataataattcagcaaaatccactaatcctgcacgatcacaagcatcttgataaattttatagatcttgatccactctcgctcttgacgatcattattatcttcaatctgattagggcgtaatccttcttcttttttattattgatataccaacaagcttgtttatagggaaaggttttttcatcatattgatgcaatttcatcaaacgcttaactaagcgaagttgatcttcactgtctaaaatttgaaaatcctgtggcaatccggcatctgcgtaatgggatcgcaataagcgattggcaatactgtgaaaagtgccaatccacataccgaatacacgttgatgggaataacgagctaaagttgcctcaatacgatgacgcatttccgtcgctgctttattggtaaaagttaccgccataatacttgattcaggtattttttctaccgcacttaaccaagcaatacgatacgttaatactcgagtttttccgcttccagcaccagcaagtacgagataattccccaaaggtgcaacaacagcattgcgttgtttttcattaagatcattaagtaattctgaaatatccattgtcgcccataaactgtgtttttatacagttgattatattgttttaaccggaaaaagcaagataagaatcaccgaataaatgctgaagcatatttcgccaactttccttcccaaatgtccaatccgtttaaatatcaaacaaattttctacataactcgaatataaacggttatttcttctctatcatgataaagatgttttgcttgcaattggaaagatatattttgtttatttaacctttcttcaatttgtcgcaggcattgttgaacctcaaaataacgctttttcataggtaattttaagttaaaaatagtttccttacaccaacctttgacgagccattgactgattaaatcagcaattctacgtggctgttcaaccatatcgcaaaccagccagtcaattttacaatgcttaggaggccgaaatttaaagccatcttcagcacaatgttcaattctgccggtctcatgtagacttgttgccattttgccatgatccactgcatacacaaaaacacctcttctcaccaattgataagtccaccctcccggacaagcccctaaatcaacagcatatttattttcgttaaaacgtgttgcttcttgattggggggaataaaataaagaattgcctcttctaattttaatgttgaacgactaggcgcttctgccggaaattttagtcgtggaatccccataatatgttcagcatggttattgttataggaatagccaatgtaacaactgttggattgagtgaaaaaaatatgcagagtaataccgctctttttgttttttgcttgtagccagccttgctttctgagagcttgtctaagcggtacagtaaattttcgacaaaaagcggccagtgttttagcttcattggtatcggcggtttctacccaaatatcactactctgtttgagattgaggattttttcttgttgacgataatattcaataatcggactgatacgatcttgcacggaaagattactaataagatcagatacgacaatcagttggcgagcaaaaatcagttgactaaatgtaatctttctagcgaggagatccgcctcaccgatttggtaacattcaaaaataacatagcctgaattttctactactctggcaaagccaaaaacaccaagtgcggtggctttttcggttatttccgccgccaattctttttcaaagccactgcggcaatataacgctaatttattcatgtttattttgcttcattgcatgcacaatccattgacggaatgcgttaatttgttctgtattggttcgattaagagaatttaccacataaaaagattttggatccggtagagagatagataacacaacttgtaagtttccgttctctatttcgtgttgagcaagaattttatttgccaacacaataccttgtccatgcacagcggcttgtaatgccataaatgtatgactaaataccggtccatgtcgaatatctaatttatccagttgaagtaaattcgccatattacgccagttatctctagtatgaacatgaataagattatgctgatacaaatctgttgcttgcgtaacaggttgtttagcgagtaatttaggggaagccaaaatcaacaattttgcctctgccaatttttcaacttgtaatcccacccaatttcctttgccataataaatggcaatatcaatttcattactcaaaggtatttcgtcttgatcaaccccttttaatctcacctcaatatctggatatcgttgattaaattcacttaattttggtacaagccattgcataccaaaagtttgcggaacgctaattgaaagatattgctcatttttctgagccattaattttgttgtagcatcggctaaattatttagaattttgctgacatcggaaaaataagcccgacccaaatcggttaattctaatgttctatttttacgcttaaataatataacacctaaaaaatcttctaataattttatttgatggctaactgcagcctgtgtaacaaaaagttcatctgcggctttagtaaaacttaaatgccttgctgaactttcaaaagatttcaatgaatttaaaggaggcaaacgtttaatcatcattcttcccaattgtattgtttaaattataacggttgaaattgctatcagattagtttttctaataccatatataaaaaaatatatcttgtctgacctatccattctccatagaatgcacgcatacttaacgattggtaattccttactggttaaagagtttcggacttaagtatgatgttgtgtttgcatattgttcgggaaaccgaaccgagtaacaaattttaagttactcatttacttcctgtatgtatatttaaaccgttttttaggttatgtaccgctctttatgagcggtatttttttatgggcaaaattctatcataaaatttcccatctctatcattccgagcgataaaaatccctttatattttaaatatccagtttccaacctgatgagaatagtgtagattaaattcactattttataaacatcaagaaggaagtaaaaatgaataaaaatattgattgggaaaatctcggttttagttatatcaaaacagattatcgttacatttcttattggaaaaatggagcatggtcaaaaggtgaattgacacaagataatgttttgcatatcagtgaaggttcaaccgcactccattacggtcaacaatgttttgagggcttaaaagcctatcgttgcaaagacggctcaattaacttatttcgccctgaacaaaatgcactacgcatgcaaaaaagttgccaacgcttgttgatgcccgaaattccggtggaaatgtttgtcgatgcctgtaaacaagtcgtcaaagcaaatgcagattggctaggtccttacggttccggtgcaacactttacttacgcccatttttaatcggtgttggtgataatatcggggtcagtccggctcctgaatatatattctcaatcttttgttgtcctgttggtgcatactttaaaggcggtatgaaaccgactaattttattgtttccgactatgatcgtgctgcaccgcaaggaactggtgcggcaaaagtcggcggaaattatgccgccagtctttatccggggaaaatggcgaaaacacgtcattttgcagattgtatttatcttgatccgactacacacaaaaaaatagaagaagtcggttctgcaaacttcttcggtataactaaagacaataaatttattactccattatcgccgtcaattttgccaagcattactaaatattctctactctatctagcaaaagagcggttaggaatggaagtgattgagggcgatgtttatattgatcaattagatcaatttaaagaagccggtgcatgtggaacagcggcagtcatcacgcctatcggtggtattcaatatggcgatcatttccatgttttttattctgaaactgatgtaggtgaaataacaacaaagctttataatgagctggtcggtattcagtttggtgatgttgacgcaccagaaggctggattgttaaagtagaataataaaaaatacacaactaatctgcaatttaatcaagtaactttccgatgaaattgcagattttttctgacataaaaatatcttaacgttgttccaatgaatttaaataatccaagacaatttgatgatgatccgtagttttaaatttatcaaaaacttgttcaatttttccctgttcatcaattaaaaaactaatgcgatgaataccatcaaaggttcttcccataaactttttttctccccaaacaccgaattgttctgccacaatatgttgctcatctgaaagaagatcaaaattcaatgctttcttttctataaaattggctaattttttcggcgaatccggactgatacctaaaataacaacacctttattttctagctctgctttgctatcacgcaacccacaggcttgcgttgtacaaccaggcgtcaacgcttttggataaaaatagaccaatacttttttcccgtgaaaattctcaagactcatctgttcattattttgatttaatagactgaagtgcggtgcaaaatcgccggcttttaatgttttcataaaatattaccttttaaaaaatataaaaaaatacttgcaaagtgttgccattttaacgatcctaaacggactttttcaagctaatatgcaaacataataaggagattttatgaccacacacagacctttattctacggcagtatcaccgcacttatcacaccaatgaataatcatggagaagttgattttaatgcattaaaaaaattagttgaataccacattgtctcaggaactcacgctatcgtttctgtcggtacaaccggagaatcagctaccttaagtatcgctgaaaatgtaaaaacaattttaaagactcttgaatttgccgatggaagaatacctattattgcaggtaccggagcaaatgcaaccagcgaagcgattacgatgaccaagctgttaaatgatagtggtgttgcaggttgtttatccgttgtaccttactacaataaaccaactcaagaaggtatgtatcaacattttaaagccattgcagaatgtacggatattccacaaattctttacaatgtcccgagtcgtaccggtagcgatctattgcctgaaactgttggtcgtttatctcaaattgcaaatattgttggaattaaagaagcaacaggtgatgtcagtcgtgtagcgaaaattaaacagatggcgggggaagatttcattttcctcagcggcgatgacgcaacagggcttgaaagtatgaaacttggcggtcaaggagtcatttccgtcacaaataatattgccgccgctgatatggcaaaaatgtgtgaattggcattagccggaaaatttgatgaagcagaaatcattaataataaattaagtgctttacataaagatttattcatcgaatcaaatcctattccggtgaaatgggcggcttataaattaggattaattcctgaaccgatattacgtcttccactgacaactttaagcgaacaatcgcaaccgaaagttattgaagcattaaaaaatgccggattgctatagtcttcttactaaacattagggtctgcaaacgaccctattttttaaccgatttctacgttaagtgcggttgttttgaggggcaaaataatttttatttttttctgaaggtttgtattgtataattcgtcgcctactgttatgcgtacgatctacgcttatctttttacaaaataaggactttttatgaaatacaaactgtcgttagcgttattatttacgcttccaacctttgcccatgcggggggggtaattttaatttttatggcaaggcggggattgatttaacgtctcgttttgaaacgatgaaaataatattaaattacaataaagaggtaacaaatgttcctgcaagttcaagacaaaacaccttctcaccaagtatctttcttgaaaccacctacaatattttaccacaaacagaaatcggtctcggactaggctatattaaacgcaaaggctttgatcattctgctacttggaagatcacacctgaaggtaattacggaattggtggtgataacaatgcagtggaaaactatagaataaatcgttattcctccctaccaatttatttcacgttgaaacaaaattatgcgttaaatgcaaacagcaaattttatctaaaaggggatataggttattcaatcaacaaaattgataacacaaaatataattactatacagatgtagatcataaaactacaacgactaatcgcaatatgaaagctcaaaacggtctatatttaggtttaggcattggatttgaatataagtctttcttagcagacatcggatattatcatactcatgcaaaagttaattataaaagcgacggaagctattcatggcacccttacaacaacgatgctatacgcttaacacttggatttaaattctaaacaatacaaaacagaataaatcttcaagctaaacttttaccataaaaatccctattgaaatattattcaatagggattttaatatattcaatcggttaaatctttacaaaaacgctacatcataccgaaataaaatgccattaccaccgcactttcccgctttccgtcaggtaaaggataataatttttacgaatatccacctcattaaaacccaaattgtgatatagctgtcttgccttaatgttcgtttctctcacctcaagccataaggtttgtatattacgttctaataattgttgaattaattctttcagtaattcttttcctaaccctaatccttgataatcaggatcgacggcaatattaaacaacgttgcctcatctaacacaagatgacaaatggcaaacgcaacaattttgccattaaccactttctttaaattaagataatgttcgccttgattattttttaatgtgcctaatgaccaaggaacaatatgtgctttttgttcgatcgcaaataattcggcaaaatcttgttcatcaatatatgaaatcattttctatatttcctgaatttgctgccaaaactgacgtttttcctgaggactttgctttaatctctcaagctcattacttttccaacaaggcatatattgcttatcgcttaaagtgcggtctattttctgttgatcatttgtgagtaaccaataaatcacttcatgttcgacttgaagataaggcaaaaaatcaaagttaatacataaacaatcttctttcattagctcaagactacgaaaaatatcttgtaaaaacggttgttcttttaaaaccggctgttcagaaatcataatcaaacgaatattttttgccacagagacatttaccaacccttttaaaatctcgggatggcgtaattgccactgtgaaatacccatttcttgtaagagtttatctcgtctgttcatttctattttcctaaataacaggctattttaaaccgtaaccgaaatgaggttaagcaataattgtgtccatttttagctcttggatttgatataaagtgaaaaaactcaaccgtagaagatcaaacctaaataagaaatcattaaattagttttgaccttctacactccagtagaattttaattcaaactttttgttcgagaagaacgcttacgagaagatttaattttatgaattggagaaagcttcacaaaatcaactccttccggtggattttctagtgcaattgttaagacttcatcaatagtgtcaaccgcatgaatagttaaattatttttcacattttcagggatttcttccaaatctttgacattttctttgggtataatcaccgttttaataccacctcgatgagctgctaataatttttccttcaacccaccaatcggtaatactttgccacgtaaactaatttcccccgtcattgccacttcagattttaccggattaccggttaaacaagaaaccaacgctgtacacatagcaatacccgcacttggtccatctttcggagtcgcaccgtccggtacatgaatgtgaatatcacgtttttcatgaaagtcattagcaatacctaacttttcagctcgagttcttacaacagtcatcgcagcttgaatactttctttcatcacatcgcccaaagaaccggtataaatcaatttacctttaccgattacagatgccgtttctattgttaataaatcaccgccaacttcggtccaagctaatcctgtcacttcaccaatgcggttttgtgtatctgctcgaccaaattcaaagcgtctaaccccaagatactcttgcaaattgttagaattcacttgaatagatttcaaacttttatctaatagcagatttttcactgctttgcggcaaattttagaaatctctctctctaaagaacgaacaccggcttctcgagtataatagcgaataatatctaaaatagcctcttcattgataaccaactcatcagtcttcaatccgttacgctcaatttgtttattcaataagtgacgtgtcgcaatattgagtttttcatcttccgtataaccggagagacgaatgacttccatacgatccagtaaaggtgctggaatattcattgagttggacgtagcaacaaacattacatcagataaatcataatcgacttcaagataatgatcattaaaatgtgaattttgttcaggatcaagcacttccaataatgcagatgccggatcacctcgataatccattgccattttgtcaatttcatcaagtaaaaacagcggatttttcacccccacttttgccattttttgaattaatttgccgggtaaagaacctatatacgttttacgatgtccacgaatctctgcttcatctcgcacaccgcctaatgccatgcgtacatatttacgccccgttgcgttggcaatagaatgccctagcgatgtttttcccacacccggagggccaactaaacataaaatagggccttttaattgatttaagcgactttgtaccgctaaatactccaatatacgctctttaacacgttctaagccatagtgatccgcatctaaggtttcctgtgctttggcaagatcttttttaactttagttcgcttatgccaaggaacttgaaccatccagtcaatataactacgcaaaaccgttgcttcggaagacattggcgacatcatctttaatttttgcaattcggcaaacactttttcacgagcctctatcggcatcttagcctcttctattttcttgcgtaattgctcaacttcatcaactgtgttttcatcatcattcagctctttttgcaatgccttaatttgttcattcagatagtaatcacgttgatttttttctatctgttttttaactctgccacgcacacgttgttcaacttgcaatatatcggcttcgcttaccattaatcctaataaatattcaaaccgtgccgacaaatctcctatttctaggatattttgcttttcattaatagataccggaagatgggctgcaaccgtatcacttaatctctctatatcattaatacgtcgcaatgcagaaataatatctgcgggaatttttttatttaaattcgcatatttttcaaattcggataaagtaattttcttcaatacacttaattctttctcatcactccattgtgtttcaattaattcgtgagacgctaaaaagaattccccattatcttgtaaatcaataagtttagttctttgttgtccttcaacaagaacttttacagtaccgtccggcaattttaacaattgaataatattgactaatgtaccaatcttataaagatcagcgatcttaggttcttcaatgtcaggttttctttgtgaaaccaataataattgcttattattttccatcgcctcctctaaactacgaatagacttgggacgaccaacaaacaatggcattaccatataaggaaaaactaccacatcacgcaatggtagaaccggaagatgctctagcttagttcgttttgcgttcatataatttactctctttcttaaaaatagactgaatgcacaggatatgggggctttttgttaaagttcaagcgaaacccaacctgctaaaacaatcaacatcattctatctaaaatgctacaaaacatgccggcactttcttttgcttatttcggagaaaattcaagcacctgttgtacgaagagtgatgtatctttagaaataaaaatctgcaccttaatcagttgtttattcactccaacttttagtgtgcagatcattttcaagtgcggtgtgtttttataaggatcttactttttagggtgatccataaaacggaagaaatcactacccggttttaaaatcatcatattattcgaaccttcaaagctgttttcataggctttcatactacgcataaaactgaaaaactccggttcttgagcaaacgcatctgaatataattttgctgctgtagcatcgccttcacctcgcaactcttgtgcctttttacttgctgttgccaaaataaccacaactttacgatcaacatcagcttgaataaatgcggctttttctttaccttgtgaacgatgttcacgagccactgcatcacgttcagcacgcatacgttgataaattgaagaagatacttcatcaggtaaattgatctgttttacacgaacatctacgacttcaatacccaattcagcagtactatcttgtcctgtattcaatgctttcttcgcatcttccattaattcaccacgagtaccggatacaatgtctttaatagttctggagccaatttcagaacgcaaacgatcatttactttacggcgtaaaagattcgaggcttgtacataatctccgccactagtggctgtataaaagcgaccgaaatcactaattctccatttaacataagaatcaactaatagatcctttttctctacagtcacaaaacgatcaggttgaccgtctaaagttctaatgcgagcatcaaggattttgacgtgatcaataaatgggattttaaaatgcaagccggggctataaacaaccactttattatctgcatcacgatgtactttactaaaccgtagcataatgccacgagttccttcatcaataatcacaacacttgaataaatcagtgcgaccaatacgataagaataggagttaagaatttacgcattaattaaatctcccttgacgaccttctataacttgataaagactgttcggttgcgaaatttccggatttgttaccgctctttcaggaacctttttttcacttgattgatcagttttaacgagcgtattgcttttctctgctaacgttttactattcaagatctgctctaacggcaatacggttaaattatttccactctgtgtatctaacatgactttcggtgtattcgccatgactttttccatagtttgaatatacaaacgttcacgtaataattccggcgatgctttaaactcaggtaataaacgttggaaacgctctacttcaccttgtgcatccaacacaacttgttctttatatgccgtcgcctgctcaataatacgttgtgcatttccacgagcccgtggctcttgctcacgagcataagcttctgcctcacgaatatagcgttgctcatcttcttgagccttaattgcatcatcgaaagccgctttcacttcctccggagggcgagcagactggaagttcacatcaatcacttctaagcccatatcataaacagcaatgatatcatttaaagttttccaagtattttcacgtacaactgaacgtccggtagttaaaatatcatccatcgtcatatgaccaattacataacgtaatgcactatctgtcgcttgatttaaactgtcatccgctctcgttacactaaacaaatatttcgccggatcttgaacacgatattgcaccgtcatctcaaccttaaccatattttcatcttgcgttaacattgaaccctgtgttcttaattcacgaacccgctcaacattcaccgctgttacgctatcaataaacgttggtttccaatttaagcccggctgaacgattgaatgtaattgtccaaaacgaagaactacaccacgctccgcttcttttatggtataaaacccgcttaatccccaaatcaccgcaccaatcaatacacctaacggtaacaatttacctaaccccaccggagaatttggcttgccgttttttccgacattaccagatttaccactgatttttttcagcaaattattaaagatctcttcaatatccggcggtgattgttgagtattcttttgttggttattcggctgctcccaatttgactgtttatcttcattatgggattgattattttccggttttttccccgtgctacccggcttaccccaaggatcttgatctgaattattgaacgacatttcattctccatttgtcaaaaattgtgacaagtctaaacaaaatattgatctaagtctaatttatttaaaactaattttgcgatttatttggtattcctcacacaaaagcaaaaaaataactcatttttcaaactctgtaatgataatcaccgcacttagaggtaacaacacagaatgatgaaaatcacctttcaaacgaatggataagaacaaaaaatagttatttaatagcaaaaaattcagaatgagaaagttattcagaagtgataaaaatcgccgaatgatcggcgattttgtataaaatgaatcaatctaaccgtttagacatagctaaccaatcggctttaaattcacgacgcatattattaattgcatcaataatatcatgatgcaccaattgttcattttggataccgacacaataaccacctttgccctgtaataaaagatctacagcgtaaacccccatacgagaacctaaaatgcggtcaaaagcacaaggcgtaccgccacgttgaatatggcctaaaatagttgctcgagtttcgtgttttacacgggcttcaatttctcgagccagctcattcacatcacataataattcagtgatggcaataattgcatgacgcttacccttaataatggcacgctcaatttgcttaattaattcttcacgattaaattcaatttcagaagcaacaatatattcacaaccacctgcaatagccgccgagatcgtcaaatcgctacaatgtctgcccataatttccacgatagaaatacgcttgtgtgaacttgaggtatcacgtaaacggtcaattgcctcaactgcggtttcaagtgcggtttgataaccgatagtataatcagtgccagcaacatcattatcaattgttccaggaataccgacacaagggaaatcatgttcttcagtgagtaattttgctcccatataagaaccgtctcccccgatgacgacaagtgcatcaataccatgtgaacgtaaaatttccacgcatttttcacgtacggcaggatctttaaactcagggaaacgagctgagccaaggaatgtaccgccccggttgataatatccgatacgctatagcgagttaattgttggatcttgttgtgatataaaccgtaataaccttcataaatcccataaacttccaaaccctcggataaagccgaacgaacaacaccacgtatcgcagcattcatccccggtgcatcaccgccacttgttaaaactgcaattttttttatcatattacttacctaatgtattgttaaaattaatcttcaaaaaaacagtgccaaggttacactattccttgccgtcgctctataaaaatttttgtgaattgcaacacaatttgatctagtttaaacttttcagctcaacttgaacaacgctggttggctcttgatgaatcgcaatatcagtgtaagaaaatcgctgtctcaattgattttctatatcttccgtaatttgatgagcttgaagaaaagacatatgatcatctaattctaaatgaaattggataaaacgaaccgcacctgaacgtctagttttaagatcatgaaaacccaaaatacgtttatctgctaaaataatttgttctatgcttttaatttcttcatccggtaaggcaacatctaaaagcaactggagattatcaaacaagattttacctgcattaatcaatatataaaaagcaattaaaagagcaaaaatcgcatcggcttgttggtaacctaattggctcaacgataatgaaattaaaatagtaaaattcatcaataaatccgtttgataatgaagtttatccgctttaattgccggactgcctgtttgtttaatcactttgctttgatatatcactaacaatgcagtagctaaaatcgaaaataaggttacaaaaacaccaatctgaaaattcatcaagggttgtggtgtatttaagcgatgaataccttgcagaagaataaataccgccgatccggaaataaatgcactttgccccaaaccagcaagagcctcagccttaccatgaccaaaagaatgattatgatccgccggcatcagtgcaaaacgcaaaatcagcatattcatcaaagacaccaataaatccaacattgagtcagtgatagacgctaacatactgacagaactcgtttgccaccaagcgaaacttttcactaaaattaataataaagcggtaaaaatagctaaattggctgcttttttcacttgttgggaataaatacgttccatttatacaattaccctcattgataacaaccgactattttatattgttcgagctgtgcgatttctttatccacaatatatttttttaaatagcgttcaattttatgtttactcattgctgatgtgggagctttcattaacttaaaagaatattgatattgaataaaaccacaaaaaggaatctctttaccttttgcaatatctacttgccaagttggatttttttctgtcggttcataaatcacaaagctgtaaagctcattatctttcaaataaagattaaattgcttcacaccgttattctgataaacatgtcgtctcaatgttatacgatccgacaaactacgtttttcacgattacgatcatgtaataattcaaccgcactttgccagttttcaacagtatgctctttcggtaaataaaagtaacgggccacagtttccaaatctaccgcactgacaagataataacttttttcatgatgcttaatatattccggtacgtttactcgagagtgtgatacacaggctgacaataaaagtgcggtcaacatagctaagattttgttcatttaattacatctcgcttaaatacaaattccgtttgtgttgaagaggatggattaaactgatacccccctaaatcaaactcttttaattgttcaatgtcagtgactcgatgttgaataatatagcgacacatcaaccctcttgcttttttagcataaaaactgatgactttatattttcctcctttgttatcaaggaaaaccggcttgataattttcacctctaattgattttctttaatggatttataatactcatctgaagctaaattaacgagaattttatcgccttgctgttcaattgcttgttgcaatgcgtcggtgatgatatttccccaaaaagcatataaatccttgcctttttcatttgccaattttgttcccatttctaaacgataaggttgcattaaatcaagcggtcgtaacactccatataatccggataatacacgcaaatgctgttgtgcaaattgaatatcgtcccgacttaatgtttcaacctccaagccggtgtaaacatcacctttaaaagcataaattgccgcacgagaattttgttcattatgctctatttgccattgttcaaagcgtgcggcatttaagccagcaagtttatcgctaatcgacattaacgaacttatttgtgccggtgaaagttgacgacaaatttttatcaatttttcgctatatgcagttaagtgcggttgagaaaaagcaaaattcggtaccgcactttcccaatctaacgttttggctggagaaataatagctaacatgttctttcctcaaatttatatcgtcattggcaattgccaattaatttcagttaaattgtgatgtcgtaaatactgattggttttggaaaaatgcctacaaccgaaaaatcctctatgtgccgacaatggcgaagggtgtggcgaggttaaaacacaatgcttagtgcggtcaataaattgaccttttttctgagcatgactaccccaaagcaaaaaaacaagatgatcacgttgttcatttaaaacatgaataacacgatccgtaaacgtttcccaaccaaaattcgcatgtgaatgtgctaatccctgttcaacggtcaacaccgtattgagcaataatacgccttgctttgcccaaccgaccaaatagccatgtgaaggagtttgaaaccccataatatctgttgagagttctttataaatatttaccaatgaaggaggcggtgctatgccgggtttgactgaaaatgccaacccatgtgcttgattgacaccatggtaaggatcttgacctagaatgacgaccctaacctgatcaaactccgtcagtctaaaggcactaaatacttcttcttgaggtggataaattgttctaccgctttgtctggcttgttgaacttgctgtaaaatatgctggaaataaggttgttgtttttcttgcccaattgcctctttccacgtattcatgattttcctcatattgatatgccaatcttaagcggcaattataaagaaagaataataaaatgcctagtttggatttgcttaatatgtataggttatttttaaattttgctaaatttaacgccttgattacgtttcaatccaatatattttttcaataaaattaaaccgctctatatcaaattaattgaaaatataaaattttttgataaaatttgcaccagttcaattcgtgaaaaaacataatgattaggagcatattatgattaaaggtatccaaattactcaagcggcaaatgacaatttattaaactcgttttggttgttggacagtgaaaaaggcgaagctcgttgcttagcggctaaagcggaattcgttgaagatcaaatcgtggcagtaagcgagttaggtcaaatcgaatatcgtgaattaccagttgacgttgcaccaacaattaaagttgaagggggtcaacacttaaatgtgaacgtattacgtcgtgaaacattggaagacgcagtaaataatccggaaaaatacccacaattaaccattcgtgtttccggttacgcagttcgttttaactctttaacaccggaacaacaacgtgatgtaattactcgtactttcacacaaagtttataatttccatctgatctgatgtgccgtattcccacatactttaaaacgtggaaatacggcacaaaatattctcgtcgactttactctccgatcttaccttattttttattgcaacaccgaaatgtctgctacttgtaaaaagagattttgtagcgtgcttaaaatcgctaagcgattttggcgaagcgtttgttcttccacatttaccattactccgtcaaaaaacgcatcaatcggctgacgtaaattcgctaatttatccaatacagccgtgtagtcgccttgtgcaattaacggttgcacttcgccttttaaggcaataaccgcttccgccaacgttttttctgccgactctacgcaaacgcctaaatcaatctcaccaatcgcaatatcggctttcgccaaaatgttactcacacgtttatttgcggcagctaaggcttcggcactgtctaatgtacggaaatgagaaaccgcacgcacacgagcatcaaagtccgctggtttggtcggacggcgagccaatacagattgaatgacgtctactgcaatgccttcactttcataccatgcacggaagcggccaagcataaactctactacttcatcaaccacatttttattcgtcagtttgtcgccaaaaagtgcggtcgcttttgccacaatgtcagctaaatccaacggcaagtttttctccacaataattcgcaaacaacccagtgcggcacgacgtaaagcaaacgggtcggcactgcctttcggggattgtccaataccgaaaatccctgtgagcgtatcaattttatccgccaatgcaacagaacaagcgactaacgaattcggcaatgtatcaccggcaaaacgtggcatatattgttcgttcaacgcaaccgccacgtcttcatcttcgccatcgtggcgagcatagtgcatacccattacgccttgcgtatcggtaaattcaaacaccatattggtcatcaaatcgcattttgagagcaagccggcacgtttcgctttcgtttgatccgccccgatttgtgctgcaatttcgcctgctaaggcttcaatacgagctgttttatcacgcaatgtgccaagctgttgttggaataacacggtttcaaggcatggcaaccgatcttccaatttctgttttaagtctgttttgaagaagaattccgcatcggtcaagcgtggacgaaccactttttcgttaccttcaataattttgctcggatcgtccggattaatattggacacgaagataaagtgcggtaataattttccgtctttatcataaatcggaaagtatttttggtcgcctttcatcgtataaaccaaggcttccgcagggacggcaaggaaacgttcttcaaatttagcggtcagtacattcggatattcaactaatgacgttacttcttccaacaactcttcttcaatatccgccactccgccaagtgcggtcgctttttctcgagatgttgcaaggatcaacgctttacgttcattgaaatcggctaccacagaaccacgttctttgagcaattgcggatattgatcggcgtgatcaagactaaattcacgctcacctaaaaaacgatgtccacgaacggtacgcccgctcgccacgcctaaaatttcgccttcaatcagatccgcaccgaataaaagcgttacggtatgcaccggacgtacaaactgctcggttttatcgccccaacgcattgttttcggaattggtaatcctgcaagggctttatcaataatgcctacaagcaagtttttagtcggctgaccttcaatcactgcacgatgcaccagccattcgcctttatcggtggaaagacgttcggcttgctcaacggtaatgccacagcctctcgcccagccttccgccgctttggtcggcttaccttcggcatcaaacgccgccgatactgctggcccacgtttttcaacttgtttgctcggttgagcctctgccagccccaacacttttactgccaaacggcgaggggctgcaaaccattccactttctcaaaagccaaccctgcttgatttaactcttgctcaacattctccgcaaatgcggtcgctaattttttgagtgcctttggtggcaactcttctgtgccaatctcggcgaggaagttttgtgttgtcattgttatttctcaactatacgttttatttaaatccatgggctaaacaaattgctttgttcgttttttggggtacttttactcaattcttcacatcgtttttacgtctaccaaataccctaactcaataaaaatcaaaaggttacgttttacttgatatcgtttttaactcgttttcttattctacactattttagatagaggcaaaacaagattgcttttgaaaacgctcaatttgccttttcgttgtactgcgttttagcgttttaaaaatcaatctaaactcatatcaaagtaacccagaaaagaaaaagaaaaagaaaggataaagagaagagaagaattttattttttttgctataaatttagacaattttgtagcaaatttataacgagatcagtataattgcacacttaactaaactagatttaatcatttgagaaaataactcaaatcaaccctattaacattaatcgaataagaagcagaatatgagcctacagcctacagcctacagcctacagcctacagcctacagcctacagcctacagcctacagcctacagcctacagcctaggctaacgcctttttataaaccttgcaaaataaattttaaaaaatttttaacttctcgtcatacccaaatttccccttttcaacccctttgcgaagatatcattcgcctttttctgctttgccttaaaaagcaaggtattgcctatttagggttatcccctctctctaaagtttaataaataatcagtaagagataataaataaataaccaataacagattcgatcaataaccacttaataagtaattaacagataatttttaaagcgagtaattctatgaacaaaatcttcaaaacaaaatacgatattacaacaggtcaatgtaaagccgtttccgagttggcaagtaatcgccaaatagcgagcagttcgaagagtaaaccgaagtgcggtgggtttttcggtggaaatttaggggcgtttaaggtgttgccgttggcgttgttgatgtcggggatgcttggtgtgagcagtgtttcatatgctgatatagtatatatagatatggatggagaaacaggagctgcgggtgtaaaaaaggactggagtgaagcacaatattggaagaataaaaaaaatattttgataacccctgttcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagaaaactctgttgctatcggtacgggagtaaatgtcttcggtgcaggagcaattgcaataggttccggagttggtgttacaaaagacaatacaatatcaatagggtatggttctcatggcttgtctagagaaagtatcgttttgggaaatgatgcaagcctaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtgcgatggcattaggtaatgaaaccgaagcaacaatggaaaattccgtggcgttggggtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaacttggattgagaagaattgtcggggtagcaccgggtgcgttggactctgacgtggcgacgattggacaattaaaagccttagaatatgtgaaaaaagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcaagcgattacagggaatcagctgaatcagcttggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattaaggctgggaatacaaaggttgaagataaggcactaaaaacagaaactcaatattcaagtaataatatcagaacagcatatcaatcgaataacaaaagacttttaatcggcataaaagaaaatcctacatttaaaaaggtatccttagaggaagaacaaacatataattctgatccaaaacaaaataaagtcggtaaaaagaacttaatcactaaaggctatttagacggtgcattagcaaatgtcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacggcgataattcctttgcgttgggtaaaaattctaaatgggaagggaaaactaccgctgcgacaggtgcggatattaatgtgggttcagcaagtttgaaatttgactggaacaatgcaggagcaggggcggataaagaagttgtcagtgtgggtagtcaaggcaatgaacgcataattaaacatgttgctgctggaagtgtaacgactaactcaaccgatgcgattaacggcggacagttgtatagcgtgattgaaacatttggtaaattaggcgttacagtattaggtgcggaagtggatagcggtacaaaacaattcaaagcaaccacatttaccaagttgaaaaatgaaaatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatgatagcgtactcgtattcggtaacggtgccaaagcctctagtgcaaaaaattccgtggtgattggtaggggttctgagtccaaagcacaaagtgcggtggtactcggtaaaggtgcgaatgttaagcaaaacgccacaggtgcggtggcgattggggaaagtgcgacagttgaagaaaatgcaggcgattccattgcgttggggaaaaattcaaaagctagcgacaagaaaaatgcaccgagtggtgcagaggtttttgctggtaaaaatagcttaaaaatcacttgggcaaatgcaggaacgtcttctgatatggcaaaagacaaaaccgtagtcagcgtaggggataagggtagcgagcggattatcaccaacgttgccgcaggtaaagtcgaaaccggctcaaccgatgccatcaacggcggacagcttgcggaagtgattagcgtttttggtaaattaggttttgatgtacttggtgcagagaaacatgatagtgaagatggttttaaacaatcnnnnnnnnnnnnnnnnnnnnnnnnnnnnnnnnnnnnnnnnnnnnnnnnnnnnnnnnnnnaagaacaagcaaaagccccaacaacctttagagaagctattaatgaaagcattacggctattaacaagggcttgatgttcagtgcggatcaaagtgcggtaacaaatggcactcaaaacacaccgcactatcttggttcgacccttagcattgtgcgtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgaacaagcgttaaataaatttaagttcaaggttgaaaatggtagtggtaagcctatcgaaatcggtcgtggcgacactttgaagtttacgaacggacagaatatccaagttactgtagcaaatggaaatggcagtgcaacacagccaagtacgagtgcttctgcttccgcaccggctccaacaccagctgctccagcaccgtcgcctgctccagcagctgctccgtcgcctactccggcaagtagcacaactacaacaccaaccacgagtacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaagtgcgggcggaaatggtgctggttcaaatgaagaagtcaccaaacttacgttagattcagaaaatgcgacattccaagttggaacaacaggtkctaaagtgaaaattgataaagagggtatttcactcacgccacaaggggcgaataacacaggcggagcaaatggagcaaatccatttgcygatacagcatcaatcactattaaagcaggtgcaaaaccagcggatccaaaaagtttagattcacttgatcctaataacggaccttcaatagagttctcagccaagaaaacaagtgatggtaaatctattggcacaggaaaaatcaccggtctgaaagatttagaagcaaattctgacggctcaagtgcggtgaataaaaactatgtggataaactggataaagtgrcggtgaaatatgatrrtgaasmkaaarawwcmatcactttaggcggtaaacctcaaaatggaggtaaggctcatgmccctgttgccatcaamaayctmaaatccggtttagggcttgatgatatgaaagataaaccggattctcaaaaaaatggattaagtcttgaactagtgaaaaaactggtttcyracggyatragtagccagcaaggrcaamaaatgacaraasawgacctgcaymragcsgcyaatctcgctgayttaaaagcggttgcacaagcwgggttgagatttaaaggaaatcagggcgatgatgtagtyagaaaaatcagcgatacyttaacyattaaaggggaagaaaacgctacaactggttctagtgccactgacaagtttaacagtacgacaaccgccgctggtaacattaaggtagaagccaatacagccaaaaacggcttagaaataaaactgtcggataccttgaaaaatatgaaagcctttgaaaccaaagaggatggcggtaaaaaagccacgttaaatagcgagggcttaaaagttgtgaacaaaggcaaagacggtaatagcaaaggtacctctgccacctatggtgcggacaatatcatgttggaagataaaggtaaaaacaataaagccacaataaccgctgaaagtcttacctttgctgacaacgtagcacaaaatcagcaaaatccaatgccaaaagctgttcttaataaaaacggcttaaccgtaaccggcaaaggcggtgaaattaagattgatggtgaaaacggtattattaccgtaccggatattaaaccaacaaccagtgaaagtgcggtggtgaataagaaatatgtggatggtcaactcagtgccgctgtcaaccgcttggataatgtgatcagtgccaacaacaaacgcttgcaatcaggaattgccggtgcaaatgcggcggctgcattgccaacgattgctatgccgggtaaatcggcacttgcagtctctgcgggtacctatagagggcaaagtgcggtggctttgggctactctcgtgtgagtgacaacggtaaaattatgttgaaactacacggcaacagcacctcaaccggcgatttcggtggtggtgtcggtatcggctgggcgtggtaagctgaggtcaaactatcaaaaaaagcagtgataatctgttccttagtcagttgtttttttaatccaacttctaggtgaagatcagaatcactgcttttttgtttgttggtgcgttgtttgcctgagaacaatgagcgataaaaaatagtcagttaaatactgaataacgatgccataatgtataggtgaaatttcgagataaaagcaaaaatctattacatcatttcattactaataaatttagcgtaaaataatgccatctataattacatagcagaaataaaaatgagcctacaagcctacaagcctacaagcctacaagcctacaagcctacaagcctacaagcctacaagcctacaagcctacaagcctacaagcctacaagcctacaagcctacaagcctagtatattggctaaaaacaaccttgcaaattcattatgaaaggttgttaatgtctaaacaaaaatccaagaccaatcaatctcaatctattactaaaaatagttttcgtttttttgatgcctataaatcattcatagatttaaaagattgttgtttatttctcagaacgaacgatatcaatactattggtatgtttgcagttaatgtacttgcatttcctcacaaaaaaacaccgcactaaaataagatgttccgagaagataatatgaatttaattatatgctgtactccattacaggtactcatcgccgaaaaaattatcgaacgttatcctgagcaaaaattttatgggattatgttagaatcattttataacgataaatttgatttttatgaaaataaattaaagcacttatgccatgagtttttttgtataaaaattgcaagatttaaactagaaagatataaaaatttactttctttattaaaaattaaaaacaaaacttttgatcgtgttttcttggcgaatatcgaaaaaagatatatccatattattttaagtaatatctttttcaaagaattgtatacttttgatgatggtactgcaaacatcgccccaaatagtcacctctatcaagaatatgatcattctttaaaaaaaagaattactgatattctattacccaatcactacaattccaacaaagtaaagaatatatctaagctacattattcaatttatcgttgtaaaaataatattatagataatatagaatatatgcctttgtttaatctagaaaagaaatatacggcacaagataaaagcatctcaatactattaggtcaacctatattttatgatgaagagaaaaatattcgattaatcaaagaagtcattgcaaaatttaaaattgattattattttcctcacccaagggaagattactatatagataatgtttcatatattaaaacaccgcttatttttgaagagttttatgcagaacgatctattgaaaatagtattaaaatatatactttttttagtagtgcggtattaaatatagtaaccaaagataatattgaccgtatctatgctttaaagcctaaattaactgaaaaagcatatttagattgttatgatatattgaaagattttggtataaaagtgattgatatctaaaatttttagcaaaaaaaaataaataaatgatcttaaattaatccgtaataatgaactttattattcactttataaagcaagctgaggagtaaatgttacggtaagttcaaccagttcatctaaagagattattttcatttgcggtaactgtacaaatattttttcacttaaatttctcgcctcaacatcaggttgtaaaaacataacaggtatattaaggcacgtaaaaagttgagggtgctttaagggtaataaaacagcatcttgccataaaactaatacatcttgtggtgtgatttggtctaaataaccggttaattcatttatgtcgtagcttgattgagaaaaggtatagagcatattatttatccctaaaaagttaaaattttctctgcctgatttagtttttgtagcaacaaagtgcggtcaattttttgacaggaaataataaaatcttggctatttaattgatatttttcacaagattgccgacaaatatagcgttgctcgatttcatacaaatccaataatttaaaggtactaatgaaatctttttgcaaaataatttcaggtttctgctgattaagtaaattaaaaacaccatcttctaagaagaagaccgcaatttcatcttcattacaaaatgccgttgccgccaacagtgcatctaaaccttctcggctaatactgctaccatgtggtgcttggcgaaagataaaagccagttttatcatattgttatcaacctatctgcttgcaaaactgccttattaaactctcctaatcctgccaaaataaaaccttctgctaaattattttgttgctggttatttgaactcagcggttcaacgatacctcgccgttgtgctgctgaaatacaaagatgcaatggaacagaatatgtttgacttaactgttgccacgctttttgtaagtgaaattcgtcatttgctggattaacaaaggcattacctaaagttaccccttgttgaaaaaaaaagatttgttcaatttgatgacctttcgccaataaggtttgtgcaaattgataagcaagatatgccccttgtgtaccataaacaggctgtttaaccgctaaaacataacgcattattctattccttgctcttgtttgagttgacggatatagagataaacggtatgtcgagagatatttaagcgttccgctactaaattaatcgcatctttaatatcaaaaatacctttttcatataaggacaggacaatttgacgatttttgttatgatttgcaacaagacgatccgctgtaatttcttcgacagtttgttctatagtttgaacaacaagctcctctactgaactggcgaaattaactgctgacatttccacttgttcaggtgcgggcatcaatgcctgaataaattgagacatgggaatatccaaattaatattaatgcaaagtaagcctataatgcgttgattaccgttacgaattgcaatcgtcaccgatttcatcaatcccttacttttagatcgagtaaaataaggtttagacacactctcggtttgcatattgtgcaaagacgttaatgcaaaatttgtaatcggcgaccccacttggcgattggtattatgtccattggcaatacaaatagccgaatgctcaaggtcttccaaagagtgtaaaacaatttcacagtgctcaccaattaatgcactaatcccctcaaccacagcgatataagaattgagaatagtatgatcttcatttgtaaaagggcgtctatccgataacatgcttaatttcccttatttttctcaccgcactttaggctatttttaatgtaagtgcggtgagttttactttatttttcagaagttacatctaagatttcaatatcaaaatatagcgttgaactcggtggaattaggcctgcacctctttcgccataagctaagtcggcaggaataaccaactcaatttttccgccttttttaatgaattgtaaaccctctgtccaacctaaaatcacttgatttaatttaaattcagcaggttgtccacgctctctagaactatcgaatactttgccattggctaatttgcccgtgtaatgtactttaacacgatctgtcggtttaatgctcttaccttctcccattttttcaatacgataaagtaaaccactttccgtttttttcacattcgattttttagcaaattctgctgtaaatttctcattttcagctttgattttagccatttttgcatgacgtgctttgttttctaactcttgcaacgtttcttgtgctttttcatcagttaaagtgcttttattttctacaacatctttaatgccagcgacaattttctcataattgtaactggcaacatctttgtgttcttcacccatcaccgttaaatattttcccataaaatagcccaaagcataagaaacatcatcattgaactgcttatcagcaaaaacagattgagaaacgaccgcacttgctattaacgctattgcagaacgttttttaatttttaacatttttcttgatcctttataataaaaatatgaaatgttgaatagattaaattgtcttgttcaaatgcacaatcattattttttaattagagactatttatgccacaaactcaagaattagatcaacgtattgcagaattagaaatgaaaattgcctttcaagaaaacaccttagaagaattaaatcaggcattaattgatcaacaatttgttttagacaaaatgcaactacaattacgctatatggcaagcaaattaaaggatttacaatcttctaatattgcaactcaagcggaagaaacacctccgccacattattaacttattgataaacatcaataatatcaagaggataggtttttccggataaataatcttccacggcttgtaataccaaaggattgcgagccgcttgtccatcttgctgaatataatggtgaaactcctccaagctcaaccaaagccctccggaaatatccggatcagaaggtgttatctcaacccaatctgttaactcaacagaaaaaacaaaccgtaaataatcagttttagaacgaggtgcatgccattggtaaatctttaataagttttgcatctctgctcgaataccggtttcttcaaataattctctttgtgcaccctgtaaaatagtttcatttttttctagatgcccggctggttgattaagtgtcattttgccgtattcaaactcttcgacaaataaaaatttacctttgcagtgcacaacacaagccattgtaatatttggtttatacatattagatactctttttaacttgttgatataaattttgtaattcggttaacgtaagctcacgaaattgtccattggctaaattggtgagcgttaaccccgctgtttcataacgaattaaacgcaatgtgggaaaaccgatatgggcagtcatacgtcgtacttgacggttacgcccttcgctaattttaatttccagccagctggtaggaacagttttacgctcacgaatcggaggatgtcgttgccaaatattcggttcagaaatcaagcgcacttttgccggtttagtcaatccatcattcaattcgatgccttttctcagctgtgcaagatcggtttccactggaatgccttctatttgtacccagtaggttttttccattttaaattttggattcgtcagtcggtgctgtagctcgccattattggttaacaataaaagaccctcgctatctcgatctaaacgtccaacggggtaaatgtgcggtatttttataaaatcttttaatgttgcccgcccttgttcatctgtgaactgacagagaacatcaaaaggcttgttgaataaaatcactttagtttgtgcaaagttaagtccccttttttgcctacgtttcagcaccgcactttttacaagcgattttatcaagttagtgttgtttaattttttgcgttgaagatccatgttttagataaaaataaataagggcaagccattagctgcccttatgctgattagatttttgccaaaatattattcaatgttgctgaaggacgcatggcttgtgctgtagccttggaatcagggtgataataaccttgaatgttttgcgacctcccttgtgcagcaagtagctcttgattaatttgctgctcattttcttgcaaggcttgtgcaattgactcaaacttcctgttaagttgttcatctttgttttgctctgctaaggcttgagcccaatacattgccaaataaaaatgcgatcctctgttatcaatcgtccccaatttacgtcccggagatttattcttatctaagaaaattgcatttgcctgatctaatgtttctgccaaaatttgtgcttgagcgttattttgcgtttgagcaaggtgttccaacgaagcttgtagtgctaaaaactctcctagcgaatcccaacgtaaataaccttctgcaataaactgctcaatatgttttggtgcagaaccgccggcaccagtttcaaataaccccccaccattcatcaatggtacaattgaaagcattttggcagaagtacctaattctaagattgggaataaatctgtaagataatctcgcaacacattaccggtagcggaaatcgtatccaacccttgacgaatacgatttaatgaaaatttgcaagcctcaatcggagataatattttgatgtctaaatgtgttgtatcaaattcagccaaataagaccgcacttttttgataacttcacgatcatgtgcacgattttcatctaaccaaaaaacaaccggcgtattggtaacgcttgctcgattaactgcaagtttaatccaatccttaattggagcatctttcgtttgacacatgcggaaaatatcgcctttctccacatgttgcaccaagtaaatttcgccatcttcaccaaccacttgaattaccccttgctcttcagcttggaaagttttgtcatgtgagccatattcttccgctttttgtgccattaatccgacattaggtactgaacccattgtagtaggattaaaggctccgttatgtttacagtcttcaatgaccgcactataaatccccgcataacaacgatccggaatgagagccaaggtatcttgtaattccccttttctgttccacattttgcctgaattacggatcattgccggcatagaagcatcaacaataacatcagaaggaacatgcagattagtaatccctttatctgaatttaccatagcaatatcaggtccttgctccattgctttttcaattgccgctttgatttcattttccttagcatggccggcgattttgctataaagctcacccaacccattgttcgggttgatgctaagttgagtaaacacatcagcatattgtgcaaaaacatcggcaaaataaacagaaacaataacaccgaaaatgataggatctgatactttcatcattgttgctttaagatgtgttgaaaataacgtaccctccgctttagattgagcttttgcttgtgctacaaaatcttttaacgcttgtaaactcatcactgaggcatctattacttcaccagcttttaacggtgcaaattttttcagcactttcttttcaccgtttgcagccacaaattctatttgaaattgtcccgcactttttaccgttacggatttttccgtaccataaaaatctccttgttgcatgctgacaacttgggtttttgattgtgcagaccaatcgcccattgagtgcggatttttctgtgcataatttttcactgcttttggtgcacgtcgatcagaatttccctcacgtaaaacgggatttaccgctgaacctaatacttttgtgtaagccgcttttatttttttttcttcttccgtctgtggttctgttggatagtcaggaacagcaaatccttgttgttgaagttctttaatggcggcgttaagttgaggaatagaagctgagatattcggtaatttaataatattagcttccggtttagtcgccaattcccccaattcagcaagggcatcaggaattttctgttcctcactaaggtaagcagataaattggctaaaattcgccctgcaagagaaatatctttggtttctacatcaatatttgcgacagcagtaaatgcttgcacaattggaaggaaagaataagtcgccaacattggtgcttcatcagttaatgtataagtaatttttgctgacataggcatgttcctgtatagatatgaattggttaattggaatgaatttgctctttatggtattagagcgttctaagcataacaaaaaaataacaataatgttattttatgcgtacaattttttcaaaatttaaacaatatctggaaagaatatatacagataaatgatatttatgtcataatccaagtaatttcattttttattttaggagctattatgtcaaaaccattaaattttgtgatgatttctccacattttcctgcaaactttgaaacttttgccgttcgtttaaaggagtgtggttttaatacattaggtattgcagacacaccttatgaacagttaagtgaaaacttgcgtagttccttaacggaatattatcgtgttgataatatggaagactacgagcaagtctatcgtgctgttggttattttgcacataagtatggtcgaattgatcgtattgaatctcataatgaatactggcttgagcttgatgcaaaattacgtacagattttaatgttcccgggtataagaacgatgatatgttggcaattaaaaccaaagcacaaatgaaagaaatttttcgtcaagcaggtctgaaagttgctcagggaaaagtatttaactctgatgatgaagcacgtaagttagctaaaaaattgaagtttcctgtgattattaagccaaattcaggagtgggtgcaagcgatacttataaaattaagtcggtacaagaattagaggactttttttcttataaaaatgcacacgttgaatacatcatggaagaatttattgatggggacattattacctttgatggtttaaccgataaagagggcaatattgtgttctattccggtcttgaatattccgagtgcgtattggataccgtagaaaatgataacgatatgttctattacgttcctcgagaaatttcaaccgacttaattaaattaggacaaaaatgtgttgatgctttcaacgttcgtgagcgtttcttccattttgagtttttccgtgtgaaaaaaacaggtgatttgatgccgttagaaatcaattgtcgcccacccggtggcttgactatcgatatgtggaattatgcaaatgattttgatgtattcagagaatacgccaatattgtgaaagaaaataaattctacacaaatattacacacccatggaatgtggtatatatctcacgtaaagcaaataagaattatgtaaactccattgaagatgtgcaacaaaaatattctactaatattattagtgtgcaaactgtaccctgcgtttttgccaaaattatgggggaacatggcattttagctcgcacagaaactttagatcagatgcatgaaattgcacaatttgcacaacaaaaagcgtaactttgttttaatttatagacaggatttccctgtctactgtaacttttaggaaaaaaataaatgcactttgaaagacgtagccattggagcggtgaattgggacgtgaaatgcactttaatgtgtatggtcatgcgggtaagcctgtgattgtatttccttcatccggtggaaatcaaaatgaatatggtaactttggtatgattgaagcttgtcgttcttttattgagcgtggcttaattaaattttatacacccgactctttcgataatgaatcttggctggcagaatggaaatccggacatgatatggcacaagcacacaatgcttatgatcgctatattttaaatgaacttgttccactaatccgtcatgaatcaaaatgggacggagcaatgattgcgacaggttgtagtatgggggcattccatacaattaactttgctttgcgtcatccggatttatttgatgttgcaattgcattgagcggtgtttacgacgcacgtttctttactcatgaatatcatggtgattctaccgtttattttaactcgccaattgattatttatggaatcaacatgataactggttcttagaacgttatcgccaaaatcattatattgtggctgttgggcaaggtgcttgggaagaacaacatatagcggatacaaaacgtttagaagaagcatttcgcagtaaaggaatagaaggttggtttgattactggggtcatgatgtggatcatgactggccttggtggcgagttcagatgccatttttcctctcaaaattggaggaacaggggattatttaatcaataaaggaaaacataaaaatctatggagatctcaaaaaatcttactacggtattcatgttccttgtattggtcataatttatatgaaattgcttatcaggcaatcagtttagcggttcgagaaataaatgatagaaacaagatcatttctaaaattgtcattagaagtcggctgatagatagtaataaataaaaaactaaggggaattcagacttaaagaacaaaattagtgatcaaaacctagttaaatccttataataaatacaaggagttaactaggtcagagacttttgatgcacattgcagtagtaatgatcttcaaaaatacgaccaaaattaaggctaaacaacgttataaatgaaaaagtgagcataaatctgctcactttttgatgctccaactacaattccttatgaattttagaattgtctttgtttatttaatggagtattacttaataatcttagcaacaacacccgcacctacagtacgtccaccttcacgaatcgcaaaacgtaacccttggtccatcgcaatcgggtgaattaagcttactgtcattttgatgttatcgccaggcatgaccatttcaacaccttccggtaattcaattgtacctgttacgtcagtagtacggaaatagaattgtggacggtaacctttgaagaatggtgtatgacgtcctccttcctcttttgacaacacataaacttctgattcaaagtctgtgtgcggtgtaattgaaccaggtttcgctaatacttgaccacgttcaatttcttcacgttttgttccacgtaataatgctccaatgttttctcccgcacgaccttcgtctaataatttacggaacatttctacacccgtcactgtggtttttgttgtctctttaataccgacaatttcaacttcttcaccagtacggataataccacgctctacacgtccggttactactgtaccacgtcctgaaattgagaaaacatcttcaatcggtaataagaacggttggtcaatcgcacgctcaggctccggaatatagttgtctaagtgagacgctaattcaagaattttttcttcccactcagcaactccatttaatgcttgtaatgctgaaccacgtacaattggtgtgtcatcgcctgggaagtcgtattgagaaagtaattcacgtacttccatctcaaccaattccaataattcttcgtcatctaccatgtcgcatttgtttaagaatacgatgatgtacggtacacctacctgacgacctaataagatgtgctcacgagtttgtggcattggaccgtctgttgccgctaccactaaaatagctccgtccatttgtgccgcacctgtaatcatattttttacatagtcagcgtgtcccggacagtcaacgtgtgcgtagtgacgtgtcgctgtatcatattcaacgtgtgaagtgttgatagtgataccacgtgctttctcttctggtgcgttatcaatttggtcaaatgcacgtgctgcaccaccaaagtgtttggataatacagtcgtgatcgctgctgttaaagttgttttaccgtggtcaacgtggccgattgtacccacgtttacgtgcggttttgtacgttcaaatttttctttagacacttttcagtttccttttattgagtccccaaaagtgcggtgcaaatttggggagttttgttgattaaataaaattattttttacgtgcttcaattactgcatccgccacgtttttcggtgcttcagcatattttaacggttccattgaatatgatgcacgaccttgagtttgtgaacgtagatccgttgcataaccaaacatctctgctaatggaacttcagcattgattttcacaacaaattcgtttgcttcttgaccgcttaccatagcacgacgacgacttaagtcaccaattacatcaccaacataatcaggtggagtttcaacttccactttcatgattggctcaagtaacactggatttgctttattaaatgccgctttaaatgctagagaagcagcaagcttaaacgccagttcagatgagtcaacatcatggtatgaaccgaaatgtaaacgaacacctaaatcaactacaggatatccagctaatggaccggatttaagttgttcttggatacctttgtcaacagctggaatatattcaccaggaattaccccacctttaatttcgttaacaaattcatatccaggaccttcaggttctagagggtataaatcaataactacatgaccatattgaccacgaccaccagattgttttgcgtgttttccttcaacatcgtttacacgagtgcggatagtttcacgataagatacttgtggtttaccgatatttgcttcgaccttgaattcacgacgcatacggtcaacgataatatccaagtgtaactcacccatacctgaaataatagtttcacctgactcttcatcagtgtgtacacggaaagacggatcttcttgagcaagacgccctaatgcaagacccattttttcctggtcagcttttgtttttggttcaacagcaacagaaataaccggttccgggaattccatacgctcgaggataattggtgcatccattgcacataaagtatcaccggtacctacatctttcagaccgattgcggctgcaatgtctcctgcacgtacttctttaatttcttcacgtttattcgcatgcatttgcacgatacgaccgaaacgctcacgtttgtcttttacagaattcaatacagttgcacccgattcaacaacaccggaatatacacggaagaaggttaaattaccaacgaatgggtcagtagcgattttaaatgccaaagctgcaaacggttcatcatcactggcatgacgctcaccttctgtttcatccggattaatacctttaatggcttcaatatctgttggtgccggtaaataatcaattacagcatcaagcatcgcttgaacacctttatttttgaatgctgatccacaagttacaaggataatttcagtttttaatgcacgtaaacgtaaaccttttttaatttcttcttcagttaactcatcacctgaaaagaatttatccatcaactcatcagaagattcggcagcggcttcaactaagtttgcacgccatttttcacattcagcaagcatctctgcaggaatatcttcataggtaaaagtcatcccttggtctgcttcattccagttgatcgctttcattttaattagatcaacaacacctttgaaattatcttctgcaccaataggcaattgtagaggaacagcattgccacctaaacgtgttttgatttgctcaacaacacgtaagaaattggcaccggtacggtccattttatttacgaaagcgatacgcggtactttatatttattagcttgacgccatactgtttctgattgaggttgaacaccaccaaccgcacagtaaaccattaccgctccatcaagaacacgcattgaacgttctacctcgatagtaaagtctacgtgtcccggagtatcaattacgttaatacgatgttgtggaaattgttgcgacatacccgaccaaaatgccgttgtagccgcagaagtaatagtaataccacgctcttgttcttgttccatccagtccatggttgcagcaccatcatgtacttcaccaattttgtgacttacacctgtatagaacaaaatacgctcagtggtagttgttttacccgcatcaatatgcgcactgataccgatattacggtaaagtgaaataggggttgtacgagccattattatttccttgtttggaataaatttaaaatatgaacaaggctccaccgcatagtaatgtgatgaagcctaaaaaacactttgctactctaccaacggtaatgtgcaaatgctttattagcctcagccatacggtggacatcttcacgttttttcactgccgcacctttgttctcagaagcatctgataactcattagctaaacgcaaagccatagatttatcaccgcgcttacgtgcagcttcaacgatccaacgcatacctaatgcgttacggcgagttggacgaacttcaaccggcacttggtatgtagaaccaccaacacgacgagatttaacctcaactgttggacgtacgttttccaatgcaatttcaaaagcctctaatgcttctttacctgtacgttgagataacgtttctaatgcaccataaacgatagattcagcgatggattttttaccatctaccattaaaacattaataaatttcgcaagtaattctgagccgaacttcggatcaggaagaatcttgcgaggttcaatacgacgacgacgtggcattgtaatttctccgttttttatcttcaggattatccaaaactctttatgtaagaaatgacatcttacttttactggagtttatggtaattaatttgttaattagcgtttggccttacttaacggagaaccattaagctttaggacgtttaacgccgtatttagaacgactttgtttacgatctttaacgccagcacaatccaatgcaccgcgtactgtgtggtaacgcacccccggtaagtctttcacacgaccaccacggattaacactacgctgtgttcttgaaggttatgaccttcaccaccgatataagaagttacttcaaaaccgttagttaaacgaatacgacatactttacgtaatgctgagttcggttttttaggtgtagttgtgtacacacgagtacacacgccacgtttctgcggacatgactctaacgcaggaacgttgctttttacaacctttttcacacgcggtttgcgtactagttggttgatagttgccattaataaaactccaatagtttttacaaaaatgtatatttaataatctatctatacaaagatagacgccgaattctaatcacacaaagtgatattgtcaagaattaagcaattctatcctgcaaaaataacgaaagattccatttagattgggtgaagatctatgctttaagtttctcaatagtttttttatcaaagaaataatgtgtaccacaacattcgcattgcatatcaatactaccgccatgttctgttaaaatattttcaatttcatcatcggaaatcaaaagtaatgcagatccagaacgctctaaagaacaaccacaatgaaattccaccgcacttggtggataaatctccacagtttcttcatggtataagcggtacaatagttcttctgcagttagtccaaataattcttcattttttactgttgcagctaatgtcgcaagatgttcaaaatcctcttgtgaaccggtaccatcaggcatgatttgtaataataatccggcagcaacaggttttccctcatattcaccggaacgaatcaataattgtgtttgtagctgttccgaacgaatgaaataatcctctaagcactctgcaatggttggtttatctaatgcaatcactccttgataacgctccccatttgttggggctatagtaattactaatataccattgccgactaactctgataaggttatatcatcatacacatcatcttgtaaacgagccaatgcacggatttgttgactatcactgccgttaactaacaataattttaacggaccgttaccttgaatttgtatggtaatattgcctttgaattttaaagttgctgtcaataaattggtagcgaccatcatttcacctaataaattccgtacaatacgaggatattcatgtgagttaagtgtatcggtgaaagtcttattcaaacgtacccactcacctcgtacggcacgatctttaaataggtaacggtaaagtttgtcattatctgtttgatatatcatatatttttcctgtttattcaaattttcaatatctatcgtctttataaattgaatgctattcctgatacttaaacttcaataaatctctccgctcttttttatttggacggcgatctgggtgtggcatagaaagtacattattcttacgtgcgattgccattttctctcgctgttcaacactcctagtggtttcacgatacaacaattgtgcttccggtgcaccacgacgttgtgcagatagggctagcacttctacttctttttcttcactaccttgacgcaatttgagtattgcaccaatttccaccgttttatttggtttagtacgttggttattataatgcacctttccaccgtcaatcatttcttttgcaatagtacgtgttttataaaagcgtgcagcccatagccatttatcgagccgaatactatcatctttttccttgggtaaatgctgttttgccatatttgtcttttcgttcagttaaaatcaggggtatgatagggggattaaagacatttgtaaaagggaagattatgaatgaattaaaaagtcaggtactgctggaaaaggttttacaaatcgctcatcaagctggagactatcttaatcttttttacaatggagaaattgattttcagatcaacataaaatcggataatacgcctatcacaaacgcagatttatttgtaaaccagtttcttatcgaaaaactgaccgcacttacgccacatatccctgttttatcagaagaaaactgtcaaattcctttttcagatcgacggcggtggcgtacttattggttgattgatccgctggatggtacacaacaatttattaatcgaacagatcaattcgctgtgctaattgcactgattcatcaaaatcggagcatgttaggtattattcatgctcccgtgttaaaacaaacttattatgccctgaaagggcatggtgcttataaacaaacggaacattctctacaaactttatcagccagaaaatttgacttaaaccatacagtaaaaattgcagtaggttcaaaaaatgcggagcaaaaagtgcggtcaattttgagctcaaattatcaatacgaatttattacttatggttctagcggtttaaaaaccgcactggttgcagaaggaagtgcagattgctatattcgactgggacaaaccggtgaatgggacacggctgcggcggaagccattttatccgaaataggcggaggaatccgtgatacccaattcaacgccctaacttataacaaacgaccgagtttaataaaccctgattttattatggtatcagacatatctgccgattggaaaaaaatctttcaatttaattaatgagaactattggaaatttagctgatttcagaatattattcacttcttttaatatcggacttagacaaaatatgaacgtaaatgcagaaaataattgtattgttatttttggagcttcgggagatttaactcaccgaaaattaatccccgcactttataatttatacaaaataggacgtttgacagaaaatttctctgtgttaggtgtttcccgaactgacttaagcgatgaagaatttcgtgaaaaaatgcgtaatgcgttgagaaaaacagaagatataacagaagaacatttggaaaaattttgttctcatctttattatcaggcgattgatacctcgaatgcttctgattatggaaaacttgttcctcgtttagatgagctacatgatacatatcagaccggaggcaatactctttattatatgtccacaccgccaagcctttacggtgtgattcctgaatgccttgccacacacggactaaatacggaagaatgcggttggaaacgtcttattgtagaaaaaccttttggttatgacataaaaaccgcaaaagaacttgatgtgcaaattcatcgtttttttgaagaacatcaaatttatcgtattgaccattatttgggtaaagaaactgttcaaaaccttctcgtattacgtttttccaacggcttatttgaaccgctatggaaccgcaactttattgactatgtagaaattacaggtgctgaagaaatcggtgttgaagaacgtggcggatactataatgattctggtgcaatgcgtgatatgttccaaaaccacttattacaagttttagccatggtagcaatggagccccctgctattattaatgctgattctatgcgtgacgaagtagcaaaagtgttacattgcttacacccgctcagcgaagacgatataaaaaacaatcttgttttaggtcaatacacatcttcaactatagatggtgaagtggtgaatggttatttacaagaaaaaggcgttccagcagactccaatacagaaacctacattgctttacgttgcgaaattgataactggcgttgggctggtgtgccattctatgtgcgtagcggtaaacggctacccactcgtgttacggaaattgtcatacactttaaaacaacgccccatccagtcttcagtcaaaatgcaccggaaaataaattaattatccgaattcagcctgatgaagggatttcaatgcgtttcggcttgaaaaaaccgggtgcaggctttgaagcaaaagaagtgtcaatggatttccgctacgctgatttagcaacaccaagcctactgagtgcctatgatcgtttattattagatgccataaaaggcgatgcgacactttttgcacggacagatgcagtacatgcctgctggaaatttgtacaacccatcttgaattataaaaaagatcaagggcgtgtttacgaatatgaagctggaacgtggggaccgacagaagcagataaattaattgctaaaacggggagagtatggcgtaaacctagcggaatgatgaagaaaaaagtctaaatcaaataaatagtaattaaacgtaataacacttgccataaggaatacgaatgaatacaaaaatttttgatacggctcaacatgcagttgaacaaatcgctcaggaatttgtgcaatatagcaaacaaaatcgtgcggtgcatatttccctttcaggaggttcaacgcctaaattgttatttaaaacccttgctcaagagccgtttaaaagcgaagtgcggtgggaaaatttacatttttggtggggagatgatcgtatggttgaaccgaataatcctgaaagtaactacggtgaagtgaaaaaattactgttcgaccacattaggattccaacagagaatattcatcgtattcgtggcgaagaaaacgtagaacaagaacttgcaagattttcgcaagagctgattgcatgtgtaccggatcttactttcgactggattattttaggtatgggagcagatggacatactgcgtcactctttccttatcaaaccgattttagtgattcgaatgtagcggtcatcgcaaaacatcctgaaacggggcaaattcgtatttcaaaaaccgcaaaactaattgaacaggcaaaacgcattacttatttagtgaccggtgaatccaaagcggacattttaaaagaaattcagaccgcacttccggaaaatttgccttatccggcagccaaaattaaagcaaaaaatggcgtaacggagtggtatttggataaagccgccggaaaattattgttatcttgatctattaattgcttaaatcagtggagcttattatgaaaaaatggttttctgtggtattaattgcgatgctttctgcttgttcgattcaaggaatttttgaaaagcaagatgtttcaacacagtttgaaattgttaaacgccgtgtgattgaaaaacacaaagtccctcaaggcatacctgacggtgaattttcaggatctgacagttcatatggacgaacatttaaaacgtttgttaaacatggctatattgataaatactttgatatttaccacccaaatggaaaattacattctcatacggtgttagttgatggtatcgcacaaggttggtcttttggttatactcccgagggcattttacgaacaaaactgttatataaagatggtgcagttatcgaaattattcttttagatgaaaaaggtaatgttattcaacatattaaacaaaaagagggataaattatgtcacaaaaaggtgatataggcgtgattggactcgccgtaatgggtcaaaatttaattttgaatatgaacgataacggctttaaagtcgtggcgtataaccgcactacgtcaaaagtggacgaatttttagcaggtgcggcgaaaggcacgaacatcatcggagcctattcattggaagaacttgccggtaaattggaaaagccacgtaaagtaatgttgatggtacgtgcgggggaagtggtggatcaatttattgaggcattactaccgcacttagaacaaggcgacatcattattgatggcggtaactcaaactatcccgatacaaatcgtcgtgtaaaagccttagctgaaaaaggtattcgctttattggctcgggagtttcaggcggtgaagaaggtgctcgccacggaccatctattatgccaggtggcaatgaagaagcatggcaatatgtcaaaccaattttacaagcaatttcagccaaaactgacaaaggtgaaccttgctgtgattgggtaggtaaagaaggttcaggacattttgtgaaaatggtgcataacggtatcgaatatggtgatatgcagttaatttgtgaagcctatcagttcttaaaagatggcttaggtttaagctatgatgaaatgcaacagatctttgctgagtggaagaaaactgagcttgatagctatctaattgatattacaacagatattcttggatataaagatgcggacggcgagccgttagtcgaaaaaattcttgatactgcagggcaaaaaggaacaggtaaatggacagggatcaacgccttagatttcggaattccattaactttaattacagaatcggtatttgctcgctgcgtatcctctttcaaagatcaacgtgtggcggcatctaaactcttcaacaagactatcggcaaagtggaaggcgataaaaacgtttggattgaagctgtgcgtaaagcattattggcatcaaaaatcatttcttatgctcaaggctttatgctcattcgtgaagcctctgaaaacttcggttggaatatcaattacggagcgaccgcacttttatggcgtgaaggttgtattatccgtagccgtttcttaggtaatattcgtgatgcttatgaagccaatccggacctgattttcttagggtcagatccatactttaaaggcattttagaaaatgcgttaagtgattggcgtaaagtggtagcaaaatctattgaggtgggtatcccaatgccttgtatggcaagtgcggttactttcttagatggttatacttctgagcgtgtgccagcaaacttgttacaagcacaacgtgattactttggtgctcatacctacgaacgcactgacaaacctcgtggcgagtttttccacactaactggacaggacgtggtggcaatactgcatcaacgacttatgatgtataattcaatctcaacacaaaaaagcggtgaactgatcaccgctttttatgtttttaaactaaagaaatagtcaatttatacaagttattcattaattgcatgatttactttgtagttaaggggtaagttgtttacaatgcacaaagattttttattcatcaggattaaaaaatgaaaactgtcaaaaaaagcaaattaattatcaccgcactgagtgcaatgttattactttcggcttgtgccactatagatgagcaaaccggagaacgtaaagatcccttagaaggatttaaccgtgtgatgtgggattttaactataacgttgctgatccttatgtgctaaaaccgattgcaaagggttggaaagaatatgttccacaaccaatcagaaagggattgactaatgtagcgaacaatcttgatgaacctgccagcatggttaatcgtttgttgcaaggtgagtttaaaaaggcaatggtgcattttcatcgcttttggattaattcaatctttggattaggtggactcatcgactgggcaagttatagtgaacctctgcaaattgaaaataaacaccgtttcggtgatacgctaggtacttatggcatggaaacggggtcttatgtaatgttaccgctttacggaccggcaacacctcgtcaagatctcggcaatcttgttgatgtaacttatccgatgttatccttattaggtccttgggggctactcaaatcgagtatacaacgccttgattctcgtgctaatctgcttggcaaagaaacattattggaacaatcaaaagatccttatgttacattccgtgaggcttatttacagaatgtagatcatcatactcatgatggacaaataaagagaacgcaagaagaattttctaaagaagacttaaaagacatcgactaaactcaagaaggaatttattatggaaatgacctcaactcaacgcttaatcttagccaatcaatatagattaatgggtttattggatccgaccaatacacaaaaataccaacgtttagaagctattgtgaaaggcggtttcggcttagaactgaaagaattggataaagagttttccgatctttcggaagcggaatgtctcactgtattaaatactttggagatgtataacgcattacaaatttcttacaataatttgccggataagtccgctttgacaccgcatcgcttacaatttgcgggctattgtgcagtgcgggagaaaaaatatcttaattacttacgctttatcacctcagtcgaagggaaatatcaagagtttatgcgttgtgaacatggttgcgactcccaaactccaatgtgggataagtacctcaaaatgcttgacgcctggcgtgcctgtccccatgaatatcatttaagcatggcagaaattcaaaaaatcttaaatgcttaattgagtcaacgttggtaaaaaaaccgcactttataaagagtgcggttttttatgtagtttctatcagtaaatttgctacaaccggtggaatacttttggggtgaggaataagaatttgcttatgccgactcagttcacctttttccaaaataatctgactttttgccactttgaaagttttacttaaaaatttcaacaagtgagcatttgcctgtccgtcaatgggtggggcagtaatactgattttcagtgcgttatcatatagtccgataaggtgatctttgcttgctttaggttgcaaaaagatcctcaaacgtaaattatctccaattttttccacagcaggcatacatttctaccaattctgacacgatttaagccaacgcccaataatttcctaataaatcatacattacacgattgccataaaataaaataaaggcaagtaacatgggagaaaaatcaaccatccctgttctaggtagtaggcgacgaacaggtttgagcaagggttctcccaattgatgtaataaataacttaaagctccacgattaaaccaacttaaaatcgctcctaaaaataaaatatataaaaacaattcaccaaaagttcttaaggtgtgtaataacgcaataattacgctttgtccaatgggaaaacgtgcacccactatcgcaaaaatcatatgatattttaatatgcctaatacaaagacaacaaagagcggtgcaaaattaatattttttattgtcggcaaaactttttgcagaggcaaaataattggattagtgaatttcaccaaagattgtgaaaaaggactataaaaatcaacacggcaatactgaaaccacatacgtaacataaaaagaaaacttaatacgtcaaaaatagtattcaataaaaactgaattgaatttaattgataaatcattataaccatcctttacgtttaaaataccaataaggtgcaaatgctgctaatgccatcagacccaatgccagcggatagccgaacttaaaacctaattccggcatattactaaagttcattccataatttgatgctactaacgttggcggtaaaaaaattaccgatacaacggagaagattttaataatacggttttgttcaatattgataaagcccatagcagcttgcatcaaaaagtttactttttgaaataatgactcattatgcggttgtagggactcaatatcacgcaaaatttctcgagcttgttctaactgattggtaggtaaacgtgttttacgcactaaaaaactcaatgcacgttgagtatccattaaacacaatcgtactttagaactggtatcttcttgttcagtgatagttgctaacgcctgatcaaaagcctcaccttgtttaccttctaaaataatacgactcaatttttccaaatcagcgtacacattttcaattacgtcagctaattgttcaattttagtttcaaataagtctaataacacctcataggcattacattcaactaaacgttgattgcgtgaacgcatacggtataaacgaaatgccggcaattcacgatctcttaaagtaaataatcgcccgtcacgaatggtaaaggcaacgctggctaaatcggcataatcattttcatcttcgcaataaaagaaagagtgtaaatgtaagccatcttcatcttcgaaaaaacgtgcagacgcttcaatatcctctaactctaaaaaagtggctaaattttgcccaagtccttcctgtaacaaatcacgctcttctttactcggctcaagtaaatccaaccaaaccgcattattcaactctttatcagcactttcatcaatacgaaccaaacgagcatcttcgagtgaaaaagcattaatcattttgtcatgctcctctaaagggattatgaacaacgcaatgaacaaaataaaatcaaataagacacgtataaagtgcggtgaaaattatatttgattaaaagatacctgaaaaataggtaatggaacttacctgcgtaatcccgccgataagtgctagaaagacaagacgagatttagaaaaaagataataggtatcgactatgactgtccaaagtgtatgtcctcttgttactaaatcgtgcggaatgttacgcttgaaatagctgttcgtcaaggctttttgcaataaaaatcccactaaaagcgggatcttataaacaactttcgatttgactactttgtagggtaatcccaccaaatatcgaataattcactgatttcaatttgttgtaaaccgtttttctccaaccagtttttcaccaaagtgcgatgactttcatcacattttcccaatttttccaagcaaactaaaccttcccaatgaagataaccgctaccttcgtaagcaagtccgttttcttgaataacttcacgaataaaacgatcaacgacttcatctacttgctcaatagaggtgttttctgcaaattgccaattcactaaaaagccaagctcttggaattctgctaagtgcatttttttacgttgtctttgattacgtttaatcgccatacttttctcctattgttactattcttgtcaggctgggcaatcatagcatatttatcgcctgtccttaataaaaaaacaaaatccgagcttatattaattatttgttgtgaagtaatgaaaaaaatctttgtatcgctggggaaataaatttgtctttataaaaaatataattaatccctctttcaaaagttaagttttttaatggaatttcaactaacagttgactatgcaattcatgcgttacagccagtcttgaaataaaggaaacccccaaattattgattacacaatgtttaattccttctaagctgttaaattccattatttttagttgtgtaatttgttcatggtcaaaatgttgaaaaataaattttcttgtttcagaaagattaggtttcatgatgagttgttgctggctaagtgcggtgaaatcgcatgctgttttttttgctaaaggatttttaggtgaagcaattaaaatgagttcgtcagataaaaatctgtgagtttgataggtttgcggatcaaaataaatttgatccgacataatcaaaaaatcaatttggtgattttctaatttatgaatgagttggggagaaggtaaaatatcaatacttagcttaacgttaggtgatatttttttatattcggcaattattttcgggagcaaataaacacccacaaaatggctggcaccaatagtaatttttccgtagttgggatcatcgtattgatggagatgttctattgaagtttccaatgtagaaagtgtttgctttgcataattttggaaaatcttgccttgttcggttaaataaagtcgattattaattcgctcaaataaaactgtatttaatgactcttcaagttttttaatcttaatacttactgacggttgcgtacaaaagagtttgttcgcagtttctgttacatttaaacattcagaaagtactataaaagctttaagttgacttaaattcatatcaattccataaaaataatttatagcttgtatagaataatacaatttttttatgtttaatcaactctctataatcagattattctatagacaatatatggagtaactcaccatgaatgacacagtaattcaaaatcaagaacaccaatctgcccgaaaagaatggctgaaaaaaatcggtattccgctagctttaactatattgcttgtattgatgtttatgccaacgcctgaggggttaacaatacaagggcaaaaagccattgctattttctgtggtgcgttaactctttgggtctgtggctcaatccctatttatttaacatctttgttagtcattattttattgccattaactcagaccgttgcaaaagataaagttgttttcgctactcttggatatgatgtaatttggttaatggtatctgcttttgtgctaacttcagcaatgattaaatcaaatattgctcgacgttttgctttatggatgatcactcattttggacaaacaccacgtaaggctatgtttgttttggtattaattaattttatattagttttcttcgtaccttctaccactgccagagcttcactcatggtaccaatttgtttaattttactggaaatttatcgtgcggtaccgggtgaaagcaattttggtaaattaatgatgttacaaggtgtgcaagctgatgcaattgcaacatccggtgtaatgacaggaactgccggtaatattattgcagttggatttattaataatcaagctggcggagatattggttatcttgattggcttttagcatctttccccgtagcttttgttaccatgataatttctttcttaattggttttaaactgttctcaatgaagaaagaaactcatttttttgaagctttatctcgtcttcaagcagaatataaaaaattaggttctttaactttagatgaaaagaaagctatggcaatctttttgcttacggttctactttgggcaacggaaagttatcaaaaagcatggttcggcttcaaaattagtgtttatatgaccgctgtgatagcagcagttctctgcttaatgccaagaattggattactcacttggtccgaagccaaaattaaatgggatttaatgctgtttgctgccggtgcttatgcagcaggtaacaccttagaatcgactaaaggtgctcaatggattatggacaaagtcgttcatggattaggtttagaaacaatgagccatacggctgtttatgtggtagtaatcttcgtatgtatgtatgtatagccacttgatttttaccagtaaaacggtcaaaacgacaattcttattccatctattattgccttggcacaatctttagggatgaatcctgtaaccttagctttagctgcgtcatttacactgacatatactataacgttgcctccacattccaaagtaaacacaatttattttgccactggttattttagtgtgttggatcaaatgaaatacggtttggttacttgctttatcggtgcctcgatcatttgtttatcaatttttacttggttccaattacttggatataccttataaaaaaacggagaggaatcatgcgattaattttattacgtcacggcgaaacgctatggaatcaagaacatcgcctacagggacaccaaaactcgccgttatctgaaaaaggtattcagcaagcgaaagcaattaagcctttgattgagcaattctcacctaaatatgtgatcagttcagatttggggagagcactacaaacagcggaaattattggttataaaaatccaattaaagacagtgagcttagagagttggcaatgggagaatgggaaggttgtagaaaaacggaaataatagctcaacatccggctttatatcaggattggcgtaatggcgattacacaccgaatggggctgagagttggcaagcattttgtcaacgtatttcacaagcactactaaaatgggcaaataaatacgatgacgatattctagctattgttcatagcggtgtaattcgagcagcttgtgaatctttagtatcgctatctactaagcatcttttgcctgtaactcaaggaacattgacgatttttgatatcagtcctaatctacctataaaactggaggcttacaatttggggagttttattcccgccagcaatgtagcggactaaaagattatttattttaaaatctagtaaaaaataaccgcactttatagactctgtttaggatttaaagtgcggtttatttttgttaggatttattttatcctttgcattttatatttttctaagttgcttgaaaacgaatttatttagaaacagttgctttaattagtttttccgctttagctaaactattttccaccgctgaataaggggtcttagagtggctaactacttgttcggcagtatttaataacactttcacttcgcctttttctgcttcggtcactaacacctttaatggtaattgtaatgcaagactgggatctttaaccatcaatggtgtgcctgcttttggggcaccgtaaataattaccgttgcaggttgcattgttagccccgattctttagccgctttttgatgatcgatttttgcaaaaatggtcattcctttttctgtgagtgtatctgtaagtacagttattgtttggtcaaaactgtatttactttcaaaagattgtggttgaagtacatcgctatgtgccattgcgacttggcttgcgaaaagtattgaaaaaagagctattttcttcataaattacctcgttatgttatgtttttaataaaaaataaatcccaaaccccatgtcctaatttatgtccacgttgttcaaacttggttaaaggtcgaaaatccggacgtgggatatagtcatttgtggcggaagtattacgtaaacctaccgcacttgttaatacctccaacatatattccgcataattttcccagtccgttgccatatgaacaaagccgtttggtaccagtttttgttgaattttttcaacaaagtgcggttgtacaattcggcgtttatgatgttttgttttatgccaaggatcggggaaaaatagttgtaatccggctaaactattgtctgcaatacagtcttgtaagatctcggttgcatcatggcaaataacacgtagattttttacctgcttttcaactgcataagcgatgcaagcacctactcccggcgtatgtacttcaataccaagataatttttatcgggattttgtagagccatttctactaaagatttccccataccaaagccaatctccaaaatcacagggttggtgttgccataaatctgtgtgaaatcaaaagcagttgtttgatactcaagtcctaatgttgcccaattattattcatcatgttacgctgaaattcgcttaaacgtcctgtgcgtaatacaaagctgcgaacttttcgtttataacgtccatcttcagtaaattcagctatttcaacggtctttcttttttgatcggcaaacgtaatcttttgttctgtcatttcatttgactacttgttaatttggggggcaaattataaggggtttaatagaaaatataaagtgcggttaaatttatcaattaagataaagccgcactttttatttgattatgttacacttctttttattttgattacctaaattatgcaggctcaatcctctattaacaatccttttgcttatacagtacttaaatggtatcggcaattcgggcgtaaaaacttaccttggcagcaaaataaaactctatatggtgtttggttatccgaggtgatgttgcaacaaactcaagtagcgacagttattccttactttgaacgttttattaaagtttttccaaatattaccgcacttgccaatgcacctttagatgaagtgctacacttatggacaggactgggttattatgcgagagctcgcaatttgcatagggctgcacaaaccataagagatcagtatcaaggtgaatttccaacggattttcagcacgtgtgggctttacccggtattggacgtagtacagctggggcggttttatcttcagtacttaatcagccttatcctattttggacggtaatgtaaagcgagtgctgactcgttattttcaggtgcaaggttggactggtgataaaaaagtagaggataagctttggcgattgagtgcagatgttacccctacagagcaggtcgcagattttaatcaagctatgatggacttaggtgcgatggtttgtactcgtacaaaacctaagtgcttgttgtgtccactagccataaagtgcggtgctaatttaaacaataattgggtagattttccgtctaaaaaaccgaagaaatcgttacctgagagaaaaagttattttctgattttggagaatcaaggtaaggttggtttagaacaacgccctatttcaggactttggggcggattatattgttttccgcagtttgataccctgactgaattattggcttatctttctcagcaaggtattcaacaatatcaacaatggacggcatttcgtcatacattcagccattttcatttagatatttatccaatttatgcacaaatacaaactgaggaagtggaatttgatcgcacagattggaaaaaaattgcagaaaataacgtagaatattgttctcctatatcaagtgcggtcaaatattggtatgatcctaccaatccaagccaaattggtttggctgtgccggttaaaaatttattgatcgaatttcaaaaaaggaaataattatggcaagaaatgtgttttgcacttacttaaatcaagaggctgaaggattggattttcagctatatcccggcgagttaggtaaacggatttttgacaatatcagtaaacaggcatgggcggaatggatgaaaaaacaaaccatgttagttaatgagaaaaaattaaatatgatgaattccgaacatcgccagttattagaacaagaaatgacaaattttctttttgaagggaaagatgttcatattgagggctatgtgcctccgacagaaaaataatttaacatgaaaaaatatattgtatttgcgattattccttttctttttgcttgtagtagttctacgctaaatgatgactatgatgaagcttttgcaaaagatactcaaggacttgatattttaaccggacaattttctcataatatcgatcaaatttggggagtaaatgaactcctcgtggcaagcagaaaagactatgtaaaatacacagataatttttacactcgcagtcatatcagctttgatgaaggttctattatgattgaaacattgggtgataaaagtcgtttatatcattcgattattcatactttattaatgggtgcggatgcaaaaggaatcgatttatttacctccggcgatgtgcctatcagttctcgtccattcctcgtcggattagttgttgatcataaaggtgcacaagttaaaaatatgacaacagcaagtaattttgcaaattatcttttacaaaataagttgcaaacacgttaccttaccaatgggaatcctgtacagtatgttattattccaatggttgcaaaccatgttgcagtgcgtgcccaacgctatttacctctaattcgaaaagccgccggacgttatgggatagatgaaagtttaattcttggtattatgcaaacggaatcaagtttcaatccttatgcaattagttatgctaacgcaataggtttaatgcaagttgtacctcatactgcagggcgagatgtattccgtttaaaagggttaaacgggcaaccgtcaaaaaaatatctctttaatcccgctaaaaatattgatacaggtgttgcctatttgactttattacgggataaatatttagatggtataacaaatccaacttcaaaacgttttgcaatgatttccgcttacaatagcggtgccggagcagtactacgagtgtttcataatgatcgagatatagcaattaacaaaattaatcgcttatatccggagcaagtatatcgtattcttactactatgcacccctctgagcaagcaagaaattatttacttaaagtagataaagcacaaaaaagttatagggtgattaagaatagcaaatctgatttgccttaataaaccataacaaaagaataattaagttacgcatgcttaaaagctaagatatacttaactgacttttcattaaacttattcatggagaactgttatgactgccctttttaccactgctcaaaactggctcgctcaagaccctgatgcggaaactcgtgcagaattacaaacattactcaaccaagccaaagtaggcgatatgaatgcacagaaagagttacataaccgttttaacggtcggttgcaattcggtaccgctggtttacgcggtcgcttacaagctggttctatgggtatgaaccgtgtactcgtggctcaagcagcgggcggtttggcggaatacctaaaaggctatgatagtgaaccctctatcgtattaggttatgacggtcgtaaaaactctgatgtgttcgtacgagataccgctgaaattatggctggtgcgggcatcaaaaccttccttttgccacgaaaattgccaacacctgtactggcttacgctatcaaatacctcaacactacggcaggcgtgatggtcaccgcaagccacaaccctcctgaagataacggctataaagtttatttaggtaaagcgaacggcgggggacaaatcgtctccccagccgatgttgacatcgctaaactgattgacaaagtggctaacggcgatattcgtgacttaccacgtagccaacactacactgtgttagacgatgaaatcgtagatgcttatatcgcaaaaaccgcctctattgccaaagagccacaagcaaatattaactacgtttacaccgcaatgcacggagtaggctatgaagtgttgagtaaaaccttagcgaaagcaggcttaccacaaccacatttggtcgaagagcaagttcaacctgatggctcattcccaacggtcaatttcccaaatccagaagagaaaggtgcgttagatttagcaattaaactggcaaaagcgaaaaatgccgagttcatcattgccaacgaccctgacgcagaccgtcttgcagttgcggtacctgattcggaaggcaactggaaacctttgcacggtaacgtgataggttgtttcttaggttggtatctagcaaaacaataccacgcacagggcaaacagggcaaattagcttgctcactggtttctagtcctgctctggcggaaattgcgaaaaaatacggtttccaatccgaagaaactttaaccggtttcaaatatatcggcaaagtgaacgacttattgttcggctttgaagaagctttgggctacttagtcgatccagacaaagtacgtgataaagacggaatttcagcagctattgccttcttagatttagtccgtagcctgaaaaaagagggtaaaacactaacagattacgctaatgactttactgcggaattcggtgcatatgtaagcggacaaatctctattcgtgtgaacgaattatcagatatcggcaaaatgatgaccgcacttcgtaaagaaccactaacagaattaggcggtttcgttacacaatttattgatcacagcaaaactgatcgtgctagcgatattctcgtgtttgtgcttgaaaatggtagtcgccttattgttcgtccatccggcaccgagccgaaagtgaagttctacttagatgtgtgcggtacagatccgaaaaatgcagacgaagtattagcggagtttgatgagaacgtacgccaaatcctccgacaagagaggtacggaaaacaggattgctaatttagcataaacacaaaagcacgttttatacctacctgttattttatcgactccatataaaaatcaccgcacttttatctcaataacgaaacaaaagtgcggtagttttacagcaaaatcagataaaattatccctgtgaagaaatacgtttcatgtctgtcatataaccacgcaattcctgaccgattaattcaatcggatgctgacgaattgcatcatttacatcacgtaacaaaatattatcgatttctgttgctggtgttgactcacctaaatcaccacgttttaacgttggaataatttctttagctaaaattggagctgctacgttagcaaataaataattaccatactcagcggtatcagagatgactacattcatttcatataaacgcttacgagcaattgtattggcaattaatggtaactcgtgtagtgattcataataggcagactcttcataaattcccgtttctaccattgtatcaaaagccaattcaacgccagctttaaccattgctaccattaatacgccatgatcgaaatattcttgttcggaaattttaatattttctcctttcggtgcattttcaaatgctgttttaccggtttgttcacgccatttcaataaattagcatcaccgtttgcccagtcttccatcatgacacgggaaaattcaccgctgataatatcatccatatgttttttaaatagaaaatccaatttttctttaatttgctcggaaagggaaaatgcacgtaacttagcactattggataaccgatccatcattaaggtaataccgccttgttttaaggcttcagtaattgtttcccaaccatattgaattaatttacccgcatatgccggatctttaccatcagcgattaacttgtcataacatactaaagaaccagcctgtaacataccgcataaaattgtttgctctcccattaaatcggattttacttccgcaacaaaagaagattccaaaacaccagcacgatgtccaccagtcgccgcagcccatgctttagcaatggctaacccttcacctttcggatcgttttcaggatgaacagcaattaacgtcggcacaccgaatccacgtttaaattcttcccgcacttccgtcccaggacacttaggagcgaccattaccacagtgatgtcctgacgaattttttctcccacttcaacaatatttaaaccatgcgaatatcccaaagctgctccttgtttaattaacggcataacatcagcaacgactttagagtgttgtttatctggtgttaaattaatcaccaaatccgccgtaggaattaattgctgataagttcctacaacaaatccgttttcacttgctcgctgaaaagaagcacgtttttcctcaatagcttccggacgaagggtataagcaatatccaaaccggaatctcgcatatttaaaccttgatttaatccttgagcaccacatccgataatgacaatttttttaccttttaagaaattaacgtcatcggcaaattcctcacgatccataaagcgacaacgacctaactggtcaagttgttgacgcaaatttaatgtattgaaataattacccatttccaatctccttatgtaatattccgctggttataaccaaattaaaatttacggtaaaagcattatacataaatttgctattgcgtaaattgactttattgaaaacttttatttcgttttctcaaatagatctgtttttgtttgtaatttatttttttaatttaaagtagtatgaaaaaacagtataattaagkggttagttaattttttcttaacttcttaattttaagaataatttcttttttgggggaataatgagaatatttaaatcaataaaacaattctttgttaagccatctgcaaaaatagggttaggtatccttttggtcggcggtgcctttgtaggaattgtaggttggattatctttaatgccattcttgaccataccagtcaagaagaattttgtataagctgccattctatgcaatatccattagaagaactcaaacaaaccgctcattggtccaatgataaaggggtttccgcaagttgccctgattgtcatttacctcacaatacggtggataaatatattcgtaagattcaagcaacaaaggaaatttttgccgaattaagcggtaaaatttcttcgaaaacagactttgaaaaacaccgtctagaaatggcagaaagggaatgggcgagaatgtccgctaacggttcggcggaatgtaaagcttgtcacagctatgatcgaatggattttgataaaatgtcggagattgcacgcaatgccatgatacctgcagctgaaaaagatcaaagctgtattgattgccataaaggaattgcacatcatcttcctgaaatgtcacattcatcatcaaaaggcaatggtttaccatcaaactctttacaagcaaataaaatctattatacggaaaataatgtcgctctttttgcagatgaaacaatggggcaagaaatcgggcagttagaaactggtgtaccagtacattttgtgaaaacaacaccaaacgcggatttagttgaactggaaatgtggcgaaaagacaaaggctttggacgaatttggtataaccaattcggaaaaaatataaccgatgccatactaacaaaagaatttatgtctgcagaacctaaatatgatgtattagaaagtattgaagatcctattaccggtctaacttggcaaaaagtaaaactttctgtatggattggtaaaaatcaacttattgaaaatattgataatttatgggctgaagcggaaaaaatttataaaacacaatgcagtacttgtcatagacaacctgatgtaaaacattttgattcaaatacttggattgggctgtttaatggtatggtcggttttactaatattgataaaccaacaggaaaacgtgttttacgctatttgcagatgcattcatctgattttcaacggcacgataataatcattaatgaggaataaaactatgcaacaatcacgtcgtcaatttttgaaaaatatgtctgttatggctgcgacttttgcaatgcctaacttcctcgttgctaaaagtgcggtggaaaataaacaagatttatcacaatggaaaattaccggctcccattggggtgcaattcgtgccaaagtcgttaatggtcgagtaagtgaaattaaaccttttgagtatgatgaatacccaaccgagatgataaaaggaatcaaagggttaatttatagcgaatctcgcattcgctatccaatgatacgattagattggcttaaaaatagacacaacagcaatacagagcaacgaggagataatcgctttgtacgtgtgacgtgggacgaagcccttgacttattctatgaagagttagaacgaattcaacaaaattacggaccttgggctttgcatacgggtaacgtaggttggcgttcaacaggacaattccacagctgtggtaaccatatgatccgagcaatcggcatgcacggacacagtgtcagtactgctggagattactctaccggtgccggacaaattatcatgccttatgtgttaggctcaacagaggtttattctcaaggaacatcatgggagattttacttaaagagagtcaaaacatcattttttgggcaagcgatccggtaaaaaatttacaggtcggttggaactgtgaaacccatgaagcctataaatatttagcccaactcaaacaaaaagtagcagataattcaattaatgtaatttgtgttgatcctgtgaaaagcaagactcaaaattatctgggatgtaaacatcaatatatcaatccgcaaactgacgtgccttttatgctcgccatagcatatgtgctttatacggaaaatctttatgataagcagttcctcaaaatgtacactgtaggatttgaaaaattcgtaccttatttaacaggtgagtcagaagataaaacagcaaaaacccctgaatgggcagaaaaaatatgtggtatttctgcaaataaaattcgtgaatttgcacatttactggcaggcaaacgaactcaattgatttttggttgggccattcagcgtcaacaacacggtgagcaaccttactggatgggtgccgtcttagccgcaatgctcggacaaatcggtttaccaggtgggggaatcaattatgcctatcattatagttctatcggtatacctgaatcaggagccgccatgccgggctctttccctttgaacttggatgaaggacaaaaaccgaaatacgaaagcacggattataacggttatagtgcgatcattcctgtagctagattatctgattccttactaaatccgggtaaaacaatcgattttaatggacaaaaagtggtttatgctccatataaaatggcaatcttcagtggttgtaaccaatggcatcgtcattctgaacgcaataaaatgaagcaagcttttcaaaaactggaaaccatagtatcaattaattacagttggacagccacttgtcgtttttcagatattgtattaccagcctgtacgccttttgaacgtaatgatattgatgtttacggttcatatagtaaccgtggagtcattgctatgcaaaaattagtcgatccgctttacgattctcgttcagattttgaaattttcaaagaattatgtcgcagatttggtaaagagaaagaatattgtcgtaacatggatgaaatggaatgggtagaaaaactttacgaagactgtcgaaaagaaaatgaaggtaaatttgctatgccggcctttgaaaaattctggaaaacaggatttgtactttttccggaaggtaagccttgggtaagacatgcagacttccgagaagatcctgaacttcatgcaattggtacaccatcaggttttattgaaatttatagcaacaaaatcgcttcctacggttatgaagattgtaaaggtcatccaatgtggtttgaaaaaacggaacgttctcatggtggaccaaaatcagataaatttaaattttggttgcaatcagttcaccctgatcaacgtttacattcacaactttgtgaatcaaaagaattacgtgaaacttatactattcagggtagagaacctttatttatcaatccaaatgatgcaaaagaactaggcattgctcatggagatcttgtgcgagtttataatgatcgaggtcaagctattgtaggtgcacacctttcagaggactatccaagcggtgtagtgcggttacaagaaggtgcatggtattcaccgttagatgaaaaaatcggctctattgatacttatggcgatccgaatactatgactcttgacataggttcttctagcttagctcaagctgtttctgccaatacatgccttgttaatattgaaaaatataaaggcattgctcctgaacctaatggtttcaaaggtccaatagaaattgcattatgataacgttgaataccgaagaaaaaatctttatttattcatggcttaaaaatatattaagccatgagttaactgaacagcagctacaacaatatcaacaaggggtttttactcccttgtttgattttttgtcagaacaagatttggtggagcaaataaatactgtccgaaactcactcatgcaattatctaatttgcctttagctcatttagaattagctgcggattttgcccaacttttcttgttgaatggagaaaatagtgctttgccttacgcctccgcttacttatcggaaaaagaactaaatcaacatattgcatttattgaccatttactgtttaaataccagctaaagtttgatcacaatctacgtgaacccagcgatcatctcgctgtttatttagaattactgataacccttgaaaagagcggtcaaaaagagaaaagttttaactttattcaacattatttattagcttggcttattccttttaataaaaaagtacaaaaaattaaaacagaaacctcgttctaccaagccataacagaaatattaatcacgctgttaaataaaaatgtaaaactctcatagcatttaacaaaatcatcaacaaattagttagtgatttttatgctggatataaaaaagctaatcttaaaagattagcttttactttatttaatttgcctttcaatcacaccgccaccgagacatacctcaccttgataaaaaacagctgattgtcccggcgtaacagcaatttgtggctcatcaaaccgcacttcaacacaatcatcattgagaggaataacctcacaagctatatcttgttgacgataacgagttttgaccgtacaacgtaaattttgacgaattggcaggcaatcaacccaatatagctgagtagcaattaaaccttgtgataatagggcggaattatcatttccttgtgcaaccactaatacgttgttaattaaatctttttctaccacataaaaaggatcttcacttaaaccttttactccaccaatacctaatcctttacgttgacctaaggtgtaatacattaagccatcatgtttgccgatgactttaccgtcaaccatgcgaatttcacccggttgtgcaggtaaaaatcttgccaaaaattctttaaatttacgttctccaataaaacaaatccccgtagaatctttctttttcgctgtaaccaaaccgagatcttctgctatagcacgaacaatcggtttttcaatttcacctacaggaaatagactttgtgctacttgggctttgctcaaggtataaagaaaataactttgatctttattactatctagaccacgtaataattttgtttgtccatttacatcggctcgacgaacataatgtcctgttgcaatataatcagcccctaaatcttctaccgcatattccaagaaagccttaaatttaatttctttgttacataaaatatcaggatttggcgttcgtcccgctttgtattcagctaaaaaatgctcaaatacattatcccaatattcagcagcaaaattaattttatgtagctttattcctaatttatcacacactgcctgtgcatcagctaaatcgttagcggcagtacaataatccgtatcatcatcttcttcccaattcttcataaacaatccttcaacttgataaccttgctgttgaagaataaaagcggacacagaggaatcaacaccaccagacataccgcaaatcactttctttttactatttttagcaatttcaagtgcggtaagttttggtagttttttttcataaacaatggatttcatatttttatttatttttaataatcaagttaattttttattgaaggtaatttttagataaaaacataaatacgctttcatattgcgaggtgtttacatcaaacatctgtaaaaatctgtcagccgcttttctatctgcaatttctttttgaacaaatcgttcaaaatctttcttcaaactgtgggaaaaagattttctcatattaataaatttgactaataatgtatgagaataataaccttgctgaaaaatatcctttaaaatattgtcctgctcgatcattaatttgttaatattatcaaattgttcttcaataattttcttatcttctgtggaactaattttctctgaaattttccatttctcagccaaaatttcatctaacttaataaaattatactttattttttcagcatccttcactggtgcaataagtgtataacttgaaccatcaatctttatttcccttgggttagtcttcttttctacagcgaaaacaatagaaaaaatttgagaaattacaagtatcaaaaaaagtaattttttcacaaaagcttctccagataaaaaatatcaagaatattaacgttatttcaactcataaaactgcggttgttttttcgcaaatttttcttcatattcagtttttgcatcttcatcaccagcagcaagtttagcctgcaagttatcacatggagtatcacaatcacagacttttttcatccctaaagcagatataccaccacaacttccagcaatggacttacgttttatgatataaccaagagacatacctaaaataactaaaacaaaaatagcaaaagtgactaaaaataatttcatagaaactccttattttttctgagttgataatatttcagcaaatttagaggacattttattttcaaacccttgtggagttttgaccgttaaataaataggtaaatcattttgctcagcaatttccagtgctttttccgcacctaaaacaaataaacctgtggataagccgtctgcagtcatagcacttttagataagactgtaattgaggctaaattatgctgaacgggctggcaagttgtaggatctatttcatgggaaaaacgttttccatcttgctcaaaataattgcgataatccccagaagttgccatagccaaatcttgtaaaccgacaacttgtgatacagatcgagttccatcaaaggttggcttttcaatagctatttgccaagctttattttcagcattatgaccatttgctcgaatctcaccgccaatttccactaagtagtcagtaataccttgctcagcaatataatcagcaactttatcgacaccaaaacctttagcaatagaagataaatcaatataaatctgcggcacagatttgatcaaaaagaatttattgtctttttgtgttagtctaactttctcaatacctacccaggcttttcgttcagctatttgctccggtgtgggtgctttttctacccgtttttccggtccaaaaccccataagttcacaataggaccaactgttacatctagagcaccttgagtaatttgatttaactttattgcttcagcaactacaaaagccaaatctgcggaaatttcaataggattatttatctccttgtttttgttgaacacacttaactctgaattaggaatataagtggacattttagcatttacatcttgtaagataccttcaatgccttcgtgcattttttgtacacttaacttagtcttgccattatcaatatatttgatatggtaagttgtacccatggttctaccatttaatgacactaactcagcttctttttggcaagcactaagtaaaaataccaacgcaaatacgtttattaaatttaataataatttcttagtcataaagtgcggttcatcctatttataagtttttactaaaggtttatcagcctttttaatatcaatatgacaatagccattaggattttttaataaataatcctgatggtattcttccgctggatcaaatcgttgtaaaggtaacacctcaacaacaattggtttactgtattttttctgttcttgtgtaagagcggttaaaataatttctctatcctgtggatcggtatagtaaatacctgttctatattgtgttcctttatcattaccttgttgatttaaactagtaggatcaattactcggaaataatattgcaaaatatcctctaaacttaatttattttgctcatagatcactttaaccgtttccgcatgaccagtattattgtataacacatcttggtaacttggattttcagttttaccatttgcataacctgaaatagcatccagcacaccatcaatacgatgaaaatagcactctactccccaaaaacaacctcccgcaagataaatagctttgttgctcatacgtaatttcctttatgcaagtataattagtttaaataaaatacaaagcggtcagcttcaaaaatttatgaaatctgaccgcactttattgatcatttaagatcagccaccaaaatcatctaataagatattttcatcttcaacaccaagatcttttaacatcttaattacagcagcattcatcactggaggtccacacatataatattcacaatcttccggtgcttcatgatttttcaagtagttttcataaagaacattatgaataaagcctgtgtaaccatcccaattatcttcaggaagtggatcagaaagagccacatgccatacaaagttatcattttcggcttgaagcatatcaaaatcttctacatagaacatttcacgtttagaacgagcaccataccaaaatgacattttacgttttgattttaaacgttttaattgatcaaaaatatgtgatctcattggtgccatacccgcacccccaccgataaagaccatctcattatcagtttctttagcaaaaaattcaccaaatggacctgaaatagtaactttatcatcttctttcaaagaccaaatgtaagaagacatttgacctggcggtacatcaggattacgtggtggaggtgttgcaatacgaacatttagcattatgatacctttctcttctggatatgaagccatagagtaagcacgaataatatgctcgtccacttttgaagtataacgccataaatcaaatttatcccaatcttcgtggtattcttttggaatatcaaaatctttatagtgaacagtgtgtggttctgcttcaatttggatgtaaccaccagcacggaatggtacttcttcaccttcaggtatttgaagtttaagctctttgataaaagttgccttattgtcattagaaataacagtacattcccattttttcacaccaaaaacttcttctggtaactcaatcttcatactgttcttcacatttacttgacaagaaagacgataaccttctttagcttcacgctttgaaatatgtgaaagttctgtcggcagaatatctcctccaccttcagtaactttcacgatacattgaccacaagaaccaccgcccccacaagcagaggatacaaagatacctttatttgccaatgcacctaataatttaccacctgctggtaagttaatagctttaccaggatcatcattaatttcaatagtaatgtcccctgaatttaccaatttagatttagcaaacaaaataagtacagctaaagctaaaacgataacagtaaacattgcaataccaagagtaatttccatttaagtatcccctattacaactgaacaccggaaaatgacataaacccaagagccattaagccaacagtgatgaaagtaatacctaacccacgaagacctgccggaacatcagcatatttcattttctctgtaataccggcaagagcaactatagctaacatccaaccggtccctgcaccaataccataaacaacagactcggcaaagttatagtcacgctgaaccataaaagataccccaccaaagattgcacagtttaccgtaattaaaggaaggaaaatccctaatgcgttataaagtgcggggaaatatttgtctaaaatcatttcaagaatttgaactaatgcagcaattaccccaatgaaagtgatgaaatttaagaaacttaaatcaacaccatcaattaaagctccatctttaagaatgagagaataaaccaattgatttacaggcacagaaatacctaatacaacagtcaccgcaacacctaaaccaaaagctgttgatactttctttgaaactgcaaggaatgtacacataccaaggaagaaagaaagagccatgttttcgataaatacggattttacgaaaaggctaatataatgttccataaattatttctccacctgttccggtttccatgttctcagaccccaaataatgaaaccgataataaagaatgcacttggtgctaataagaataaaccattggtttgataccatccaccatcttggatagtttgaaaaatagtcataccaaataatttacctgaaccaattaattctcgaataaaagcgacagtaactaaaattgctccatagcctaaaccattaccaataccgtcaacaaaactttctattggtgcagatttcattgcaaaagcctccgcacgtcccatcacgatacagtttgtgataatcaaccccacaaaaactgaaagttgttttgataacccataagcatacgcacgtaaaatttgatcaaccaaaattactaacgaagcaataattgccatttggacaattatacgaatactgttcggaatataattacggattaaagaaataaaaaagcttgaaaaagctgtaacaagacttaccgcaattgccataacaactgctgtttcaagtttggttgttaccgccaacgcagaacaaatacctaaaatttgtaatgcaatcggattattatcagtaatcggtgataataataactttttaatatttgcatttgccattagttagcccccttttttagttttgctaaatatggaccaaagccattagcaccaaaccaataatcaaacgtaccttgaactcctttagaagttaatgttgcaccggaaagactatcaattccatgttgtgcatcagacgatgcacctttacctacacgaatagccggttgattttcttcatcaagcagtaatttaccaacaaatttagcttgccattttggattttcaatttcgcctcccaacccaggtgtttcaccatggtcatagaatgtaatacctttaattgtattaccatccggttgaattgaaacaaaaccatacattaccgaccacaaacccgtaccatacacaggtaaaacaatttggtttatctgattgttctcatctttaacaagataaacttccgctaatttagcacgttgacgtaaaccagctttatcatcttgaggggcaatagaaacattttgagcggaatctttcgctgcagattttgcatcaaaaccggtaggacattttacataatcaccagaatttaattccacacaacgagcttcaatattcttagtaaaaatatccttaatttgaccggtttttgtatctttttgcaacaatcctgcaacacttaaaatatttttttgcttatcaagttgtttttgttcttcttgtgttggttttaacaataccgcagaaccagcaacaataatagaacaagctaaactcaacagaacaacaatcgaaattgttcctccaacactatctttattaaatttagccattgcgagatctccgacgtttaatatttgcttgaacaacaaggtagtcaaataacggtgcgaataaattagcaaataaaatagccagcatcataccttcaggatatgctggatttgccacacggataattacagccatcacaccaattaatgcaccatataaccatttacctttattagtaaatgcggctgaaacaggatctgttgccataaaaaacatacctaatgcaaaaccgcctaatacaaaatgccaataccattgcattgcaaataatggattagtttcagatccaataatattgaataaagttgaagttgcaatcataccaatcatcacaccagcaatgatccgccaagaagcaattcgagcaaaaacgataattgcagctccaattaataaagcaaaagtagaaacctcacctatagaacctggaatattacctaaaaaagcatccatccaagtaataggctcgcctgttgcaacatgttttaatgcaacttgtccacctgcagcccattgagaaagtgcggtcgcaccagagaagctatccgcagctgtccaaaccaagtctccagaaatttgagctgggtaagcaaaaaataaaaacgctcgacctgctaatgctggattcatgaaattcttaccaacaccgccaaacacttcttttgcaacgacaacaccaaaggttgttgccaatgccgcttgccataatggtaatgtagggggaacaatcaatgctaataaaatagatgtaacaaagaaaccttcattaatttcatgtttacgcaccattgcaaataaaacttcccaaaatccaccgaccaaaaagacagttatgtaaattggtaaaaagaaaattgcacctaatgccattttagctaaaacaccagcatcaatagacactaaaccaagcatgtttgctaatgcaaagtgccaatcattagctacattttgagctaagtttgcagaaaaatcaccaacacttaatgcaagaattgattgtgcaccaacattatacattccgtaaaacattgcagggaataatgcaagccaaacaagcaccatcatacgttttgagtccaatgcatcacgaacatgtgaagatttacctgttactgtacccggcgtatataaaaatgtcgctgtcgcttcgaacaatgcataccatttttcatatttaccacccggcaaaaaagcaggttccattttctctaaaagatgttttaaacccatttttaaccttccttctcgatcttatctaatgctgcacgtaacatcggaccatattcatttttacccggacaaacgaaagtacataaagccaaatcttcttcatccaattcaagacagcctaaagcctgtgcactatccgtatcacctgatgctaaatcacgtaataataatgtaggtataatatctagaggaacaacacgctcatatgcaccaatcggtaccatagcacgatggccaccatttactgcggaagtaaaattaaataatttactgctgaaatgtcctagtactgttcgagtaatggaaaatttgttttttccaggcataatccagcctaaaaattctttctcacgaccttcagcaataacagatacttgcaaagcataacgtcccaaatagttatatggaccgattgctgtattaccacttaacactgaaccggaaataactcgattttcacccgcacttaattcattttccgttaaatgtgaaagatttgcacctaactgcgtacgaattaaacgaggatttttaacttgtggtccagctaaagaaaccactcggtcagtataaattttgcctgtagtaaataatttaccaatagctataacatcttgataattcaaataccaaactgatttagttgcactaacaggatcaataaaatgtatatgtgtaccacttaatcctgctggatgtggtccactaaaatcatgaacagctaagttaggtaaatcaatcgttgggatattgctatcaccagctttacacaaatgtaatttgccttcatgtaaacgacttaaaacggttaatccatcagtaaaatcctgccaatgttcttttaacacaatttcaggatttgctgataatggatttgtatccattgcattaacaaaaatagaagaaggtactgcatcactcgcaggtactttactgaaaggacgcgtacgaagtgcggtccataaaccagaagattgtaaattttgacgaacttgctctgaagtcaattttttcaattcatcttcattatattgagtaaaggtaatttgttcattaccttccactttaattaccacagattgtaaaattcgcttagcaccacgattaatcgcagttacagtaccacttgcaggtgcagtaaatacaataccaggattttttttgtcttcaaaaagtacctgaccttttttcactacatcaccttcacgcaccttcatcgaaggtcgcatacccacatactcttcgccaagcaaagcaacttctttaacagcattgccgttatggattacttgttctggttttcctgcaataggaagatccaagccttttttaattgtaatcatattgtttgcactacttttcgttagattaaaatatagttgtaacaaaaaagtaacaaccgcgtcttgagtaatgatttcagccgacgaactactaaaaatcaatttatccgcatcaatcacataaaaataaaactcaaattctgttttttactgtacctagcttaatgatagaaacaataaattaaaaatttactaaaaatcaacgagtcattttaactaaataatgactccgattccactttagacacctttttttatgattttttatgaattttttgatctatttttgtaaaaaaatcaattctaaatcaaaatattgctaaagagttactgaccaatacctgaacaattaggcgactttggaaaaactttgcctaatttttcccattcttcaggactatataaatgtaaagctaaagcatgaataccttgttgtaactcactactaaacaatgaataaactaaacgatgacgagcgacttttgtcaaggatgaaaacctattgctcacaacaactaatttaaaatgagagttagcacctcgacctgagctgtgcatataactttcattttctatctgtaaaaagtgcggtgaaaattcttgtaatagctttttttctaggactttttgtatcgacataaatttatccttatttttactatttgatatttgatatataacactatattttcattaataaaaaacagattttatttttatcttacatcaaaaatagatttttttattactcaactctgtttttttattgcatactctttcattacatcaacaaaaaaccgccttttggcggttttttatttataagattaacgttttctttgtgttaaacgatctgttaattcataagcacgtaattttgccaattctcttgaaagtttagataccaacatttcataattagcatctttggcactagaaacaatattttgttcagccttacgtttcgcctccaaaatacgttctctatcaagttccttaccacgaatagcaacatcagctaaaacagttacaactgttggttgaacctccaaaaaacctcctgaaatgtaaataacttcctcagtatcatcttcaagagtaatttttataatacccggcttgatagcggtaagtaagggtaaatgtccggctaaaatacccaactcaccttcagaacctgtagcttgaatgcctttaacttcaccatcaaaaatatgttgttctgcacttactacgattaatttaaatgtcgccatctttttctccttcaagtttgctgttaatcagtcttgaagtaactacatttttttggctttttctagcacttcttcgattgagccaaccatatagaacgcttgttccggtatatgatcgtattcaccatctaaaatacctttgaaaccacgaatagtatcttttagtgatacatatttaccaggagaaccagtaaatacttctgcaacaaagaacggttgtgacaagaaacgttctattttacgtgctcgtgctaccactagtttatcatcttcggaaagctcatccataccgaggatagcaataatatcctttaattctttatagcgttgcaaaataccctgcacacctcgagctacatcataatgttcctgtcctactactaatggatctaattgacgtgaagtagaatccaaaggatcaacagctggataaatacccaaagaagcgatattacgacttaacaccactgttgaatccaaatgagcaaaggttgttgccggagaagggtctgtcaagtcatccgccggaacataaacagcctgaacggaagtaatagaacccgtttttgttgaagtaatacgctcttgtaaaacacccatttcttctgctaatgtcggttgataacctaccgcagaaggcatacgacctaaaagagcggatacttctgtacctgccaaggtataacgatagatattatctacgaaaaataatacatcacgaccttcatcacggaatttttccgccatagtcaatcctgttaaagcaacacgtaaacggttacccggcggttcattcatttgaccataaaccaacgatactttatctaatacattagattctgtcatttcatggtagaaatcattaccctctcgagtacgctcacctacacctgcaaacacggaataacccgagtgttcgatcgcaatattacggattaattccatcatatttacggttttacctacacctgcaccaccaaataaacctactttaccccctttagcgaaaggacaaattaagtcaataactttgattcccgtttctaaaagttctgtactgttcgattgttcttcatagcttggtgccgcacggtgaatagcccaatattcttccgcaccaatctctcctttttcatcgataggttctcctagtacgttcataatacgtcctaaggtttttgttcctaccggaacagaaattggatttcctgtattttctacttttaaaccacgttttagaccatcagatgaacccaatgcgatacaacgtactacaccgccacccaactgttgttgaacttcaagaattaatcctgattcaacttttaatgcatcataaacttttggtactgcattttgtgggaattcaacatcaattaccgcaccgataatctgtataatttttcctgctgacattaccttatctccattaaattgctgctgcacccgcaacaatttcattcaattcatttgtaatacttgcttgacgagctttattatacaccaactgcaagtcattaattaaattacctgcattatctgttgctgctttcattgctaccattctagcggcctgctcagaagccaaattttcaacaaccgcttgataaacttgagattccaaataacggactaataaactatccaacaaagtttgaggatttggttcgtaaatgtattcccaattatcactatttttgcctaagctatcattatctaattccggtaatggaacgagtttttccattattggtttttgcgacatcgtattgataaacttattataagtaacatagattgcatcaattttaccttctttataagcctcaaacatacgatttgctataccaattaattcttcagctacaggggtatctcccatacctgaatgctgagctttaatatttaaaccaagagattggaaaaaacctataccttttgctccaattaaacctaatgaaacttcaacattttgttctttccagttttttatttcagaaagtgcggtcttaaataaattaacatttaaaccgccacataaacctctatcggttgaaataattaagatgccaacgtttttaacttctcgttcaatcaaaaatggatgttgataatcaatattggcttttgatatatggctaattacaccttgtattgctttagaatacggacgtgaagacgacatacgatcttgcgttttacgcattttcgatgctgcaaccatttccattgctttagtaattttttgcgtactttgcacactggatattttggttcttatctcttttgcaccagccattttatttctccgttaattaactattaccatgcaacatttgctttaaattgatctaaaacggtcttcaatgtatttttaatttcatcatcataattaccagttttagtcaactcagccataaaatcagcatagttgtagtttgcatattctaaaagtgcggtttcaaaagtacctatacgatttaattcaacgtcatctaaataaccaaattcaacagcaaataataccagagcctgttcagcaacacttaacggtgaatactgtttctgtttcaataattcagttactttttgtccatgtgataattgtttacgtgtagcttcatcgagatctgatgcaaattgagcaaaggcagctaattcacgatattgagcaagtgcggtacgaataccaccagccaattttttaactactttggtttgtgccgcaccacctacacgagaaaccgaaatacccggattcactgcgggacgaatacccgaattaaataaattggattccaagaaaatctgaccatccgtaattgaaattacattagttgggacaaatgctgaaacatctcctgcttgagtttcaatgataggaagagcggttaaagaacctgtttttcctttcacttcaccttttgtgaatttttctacatattcttcactcacacgagaagctcgttcaagtaaacgagaatgaagatagaacacatctcccggaaaagcttcccgacccggtggacgacgtaaaagtaatgaaatttgacggtaagcaactgcttgtttagataaatcatcgtaaacaattaacgcatcttcaccacgatcacggaaatattcacccattgcacaacctgaatatggagcaaggtattgtaaagctgctgactcagatgcagaagctacaacaacaatagtattttgtaatgctccatgttcttctaatttacgtactacgttagcaattgttgatgctttttgaccaatagcgacatatatacattttatacctgaatcacgctgattaatgatggcatcaatagccaatgctgttttacctgtttgacggtcaccgataattaattcacgttgaccacgaccaataggaaccattgagtcaacagccttatagccagtttgtacaggttgatcaacagatttacgttcaattacacccggtgcgataacttctaccggtgaaaaaccatcatttttgatttcacctttaccatcaattggctgtccaagggtatttactactctacctaataaccctcgaccgaccggtacttcaagaatacgacctgtacactgaacttccataccttccgctaaatcagagtaaggtcccatcactaccgcacctacagaatcacgttcaaggttaagtgccatggcataacgattacccggtaatgcaatcatttctccttgcatcacatcacttaaaccatgtatacgaataattccgtcacttacagaaacaattgtccctgtattacgtgcttcgtttatcacctcaaactgagctatacgttttttaatcaattcactaatttctgtcgaatttagttgcatattttattcctcttacaatcgcaactcatttgctagacggttgatttgtccacgacaactaccatcaataacaaaatcatttgtacgaataatagctcctgcaattaacgaactatctattctgcaatttaatattactttacgagcaagtcttttttccattgcggtaataattttctgttgctgtgcatcatttaactgttgagcagaaataacttcaacttgtgatagagatttatattcttcaacataagatttaaactcgttaaatacagctggaagtacagctaaacgcttattttcagccatcaacctaactaaattttgcccatattgatcaagttgttcgccacaaattgagatcacagtatcagcaagtttaaaagtagaactagtgcttgttaagtaagtttgaactttatcatgacgaataagctcagacaaaaactctaacatattagtccatttttctaccgcacttttatctttttcagactgctctactgcaaaatcaaataccgctttcgcataggggcgagctatcgtagttaattccgacatagtctcaaccttcctataaatctgcaactaatttatcaataatgtcattgttcgccgcttcatcaatgttgcgacccacaattttctcagcaccggcaatagcgagagatgcgactttaatacgcaactcttcttgaacacgtttacgttcagattctatttctgcatgtccctgttcaataattttctctcttaatgcctcagcttcaattttgacttcttccaaaatttcattgcgacgtttattcgctagatccactatttcctgagccttaattctagcttgattaatttcttgctcaactaaaacctttgtatcggattgctcttttttagcagcttcagccgaagctagtgcatttgcaatagatctttgacgttcttctatggctttaataatcggtggccatacatatttcatacagaaccacacaaaaatagcaaaagcaatcagctgacctattaatgttgcatttaagttcacaatgccctccctaaaattggatttattcttctaaagaataatatgattatttatccaactttaattagtttaataaaccaatgaatggatttgcaaaaataaatagtaatgcaatacctactgcaatcattgaaatagcatctaaaagaccagctacaataaacatttttgtttgcaagctagctgctaattcaggttgacgagcagatgattctaagaatttaccgcctaaaagactaaaacctatagcagtaccaagtgcagcagctgctaataaaattacagaaccaaaaatagttgcagtaataatgttttccataatattctcctatagatgtagataaaagtttagccaaaagctaagttgttaaaaaatcaatcgaaaatgtctagtaaaaataatttcataaaacagatttaatgatctgatttattataagctatacttagatatactacagtcagcatcataaaaataaatgcctgtaaagtaataactagaatatgaaaaatagcccaaattaaatgcaaaggaatacctaatacttgcggaataatattatctgccatatacataacagcaataaggacaaaaataagctcccctgcgtacatattaccgaataaacggaaggctaatgaaataggcttagccaaaagggtgactgcttccaataaaaagtttacaggaataaatgcccaatggttgaatggatgtaaggtatattcttttacaaaaccacctaaccctttagacttaatcgtgtaaaaaataattaatgcaaacacacaaacagacatacctaatgtcgcactaatatcggctgtaggaactgctcgtaaataatgaatacctaataactcggcaaactgcggcggaaaatcaacaggaatcaaatcaatagcattcataataaacacccaacagaatattgttaatgccaatgatccaatttgatgacgaacatcacttccgtgaatattatctttaacaacaccatcaacccactcaactagcatttcaactaaacattgaaattttccgggaactcctgatgttgctttactagcaatacgatagaaaaagaaaaggaacaaaactccagatactaaagaaaaaaataaagtatcaagatggacattccaaaaaccttgtccagtagttaagaatgttaaatggtgactaatatagtcagcagtagtatggccagccatagttaatcctttttaaaactaaattttaaggtatttatttaccataaaaggcaaaagattattcaatacaatacttataagataacctacaaaaaaaactttaaaatcaaccttaaatgttttaaaaatgaatacaatcaaaataattgttaagataaacttaatcaattctccactataaaacatttttaggttatttttatactttttgttagtaaaaaacattaaatacacaaaaaggcaatatggaataaaaactgaaagtgcaccaaataagaaagataagtacacttcatgatcactcataccgcctatactcagtaaaacaaaagaaaacataaaaataaaaaactcaattaataatgaaattttatatcttttttgagttttttttattacagcagacatcttatcgttctaatttgctacttacaaaaatcttgccagttacaagcctatttttgcgaatttttaacttaaaatcattttataaatgacagtttcgaccatattataaataattcattaaatttattctaatcttttttaacaaaactaaatgacgcttaccaactaattcaggaacattcaattctatgattttatccacagaaaattgagcagataaagccgaaacttcttccatattatattgaccttttaaagcataaaaaaaaccttgatccgttagtaaatgttgacaccattccgtcatatcttttaaagatgcaaaagctctacttaaaaccccatcaaattgatgatcaggtttaaattcttcaactcgacttaaaacaggttcaacattagttaattcaagttcacgaactgcattacgaatgaaactaatacgtttaccgagactatccaataaaaaaaactttttgtcagggttaattatagctaaaggtaatccaggtaatcctggaccagttccaacatcaataaaaatatttccttgtaaataaggactcacaacaatactatccaaaatatgctttaccaacatttccataggatcacgcacagatgttaggttataagccttattccatttgtttaataataaaaccagctgaactaaccgctctttttgtaaattagtgggtaaaagagcggtattttttaaaaaaaaatttagtttttccattaaattcttttgtaaatcagccattattcacctcttttcagcataccttgtttttttaaattaacgagtaaaatagaaatagctgcaggcgtaatacctgaaattcgactcgcttgaccaatagaaattgggcggtattgttctagcttagcacaaacttcattggataatcccgatatatttttataatcaaaattagcaggaatagccgtattttcatggcgtttttgacgctcaatttcttcttgttgatgttcaatataaccttgatatttaattacaatttcaacttgttcaacagcttctttgtcttccattgccggtttaaaaggagtaagtgcggtcaaaatttgataatttatttcaggacgacgtaataaatcttccccatttacttcacggacaagtgggctttttaatatttcattagcctcatttaaatattcagaacgaggatgcaaccagattgaacgcaaacgttgacgttccagttcaatattttccattttttgattaaatcttgcccagcgaatatcatcaattaatcctaattctcttgcaattgaagttaaacgaatatcagcattatcttcacgcaacaataagcgatattctgctcttgaagtaaatactctataaggttctttagttcctacagtacaaagatcatcaaccaaaacacctatataggcttgatctctacgaggaaaccaactttctttttcttgaacaaataaacctgcattaataccagctaataaaccctgtgcagcagcttcttcatagcccgttgtaccattaatttgaccagcaaaaaataaaccagaaatagcttttatttccaaagttggttttaagtctcttggatcaaaataatcatattcaattgcataacctggtttaacaattcttgctttctctaatcctttcattgaattaacaattttcatttgaacatcaaacggcaaacttgttgaaataccatttggataaacttcattacttgttaaaccttccggttctaaataaatttgatgagaattacgatcagaaaaacgtattactttatcttcaatagatgggcaatagcgtggtccaataccttcaataactcctgtatacataggactacgatctaaatttttgcgaatcacatcatgcgtttgatcattggtatgcgttatatagcaaggaatttgctccggatgttgttctacagatcccataaaagaaaaaacaggtaatttttcatcgccatattgtttagctagaatatcaaaattaatagtacgagcatcgatcctcggcggcgttcctgtttttaagcgatttactcttaaatttagatccctaagttttttagcaagatttacagatgcaggatcacctgctcgaccaccagcatagttttctaatcctatatggatcttaccggctaaaaatgtacctgcagttaatactactgactttgccctaaattttaatcccatttttgtttcaacacctgtaactctatctttttctaaaataatatcggttacttcttgttgaaaaatatctagattaggttgattttcaagagcaatacgtacaacttggcggtaaagaacacgatctgcttgagctcgtgtagctctcacagcaggacctttgctactatttaaagtgcgaaattggatacctgctttatctgcagctgttgccattaatccgcccatagcatcaatttcttttactaaatgtcccttacctattccaccaatggccggattacaagacatttgtcctaaagtatctatattatgagttaataaaagcgtttttagtttcatacgagctgtcgctaaagcagcttctgttcccgcatgcccaccaccgattacaatgacatcgtaattttctgtataaaacataatagtctaagtgttattaaaggttttagagttcaaaatagcgatctattctacattaaattacaagataaacaaaaagaagaaagaagtaaaagatcatcagttgatcttcttcctaatataaatagaatctttttatatataaaagtattattatgtatattattaggatctttttttttgttaataagtgtttttttattttttaaaataataagttggatcttttttttattgttatgatctagatcgtttacagtaaaaaatctgtggatatttttatattttatccacaaattttttttaataaaaaacttttttatcttaataacaggaaattttttgttttttattaaagttatccacagagtaatgtaaattaattgaataaatttagattaacattttttaaccagttttcagcaaaatgatcaggatcatcaacattcatgacatctatttttaaactttctgtaatttttacagcttttttattcagtaaaatgtcttcaatttgattcacagcatagcaaaaagtatcataatcggagcttcctaaaccaataacagcaaaacgtatttgagaaagatctaagtttttttgtgtaatttcttcaaataggggttttaagttatcaggtagttcaccggaaccatgagttgaactcactattaaccaatttttatgtttaattacatcatttagtgaaggaccatgtaatagattagtcgatacacctttcttatctagtaagaattgaatatgttcggctacgtattctgcacctcctaaagtacttcctgttagaatgcaaatttgtttattcatcttaataccttaattttagttaaaaaaataggcttagaattaatctaagccattgattttatgaatttaaatattatcaatacgacccaataatgaacgtaatcgttcttgccagttatgatgttctttttttaagtgttcattttcgctacgtaattgttcattggtttgacgagatagctcatttttttcttttaattcttcaatttctaattgaagtaattggattgtttcaacagcttgtttaattttttcttctaattggtctaaaatttctaaagacatgatgatttccttttaaataaaactaatttgcgtagttattttaactcagttgtctattatttttaaggaaatttatgaaaaatttatatgttgtatggcattgtgcaatcaatccattatttgtaatagaaaatataccgctctttatgttttattggagtataacatcagcagtaagttgataaaaattagcctattaagcaaatttttgctataatccgagccaatttttatttataaaaaagagaaattttatgtcagaaaatacaactgaaaattatggtgcaggaagcattaaagttttaaaagggcttgaagcagtacgtacacgacctggaatgtatattggtgatactgatgacggtacaggcttacaccatatggtttttgaagttgtagataatgcaattgatgaagctttagcaggttattgtaaagatattattgttactattcatgcagataactctgtctctgtgcaagatgatggacgtggtattcctgttgatattcatcctgaagaaggtgtttcagcagcacaggttattatgacagtattgcatgctggtggaaaatttgatgataactcctacaaagtttcaggaggattgcatggagtagggatttctgttgtgaatgccttgtcggataaattacaactcactattcgccgtcaaggaaaagtgcatgaacaattttaccatttaggtgatcctcaggaacctttatccgttattggtgaaacggaaaaaacaggtacaactgtacgcttttggcctagtcccactatttttactaatattgattttgaatacgaaattttggcaaaacgtttacgtgaactttcatttttaaattcaggtgtatcaataaaattattggataagcggaatgatcgtcaagatcattttcactacgagggcggtattaaggcttttgttgaatacttaaataaaaataagacaccaattcatcaaaaaatattttattttagtgcggaaaaagacgatattggtgtagaagtagctttacagtggaatgatagttatcaagaaaatgtttattgtttcactaataatattccacaacgagacggaggtactcatttagctggttttcgtggtgcattaactagggttttaaacaaatatgtagaagaaaattcgaataaaaaagacaaaaaggatatagcaacttcaggtgatgatgcgagagaagggttggttgctattgtttctgttaaagtaccggatccaaaattttcttcacaaacaaaagataaacttgtgtcttctgaagtaagagctccagtcgagtctgttatgagtgattatttacaagaatttttggaagaaaatccaaatgatgccaaaattattgtaatgaaaattattgaagctgctcgggcaagagaagccgctcgcaaagctcgtgaaatgacacgtagaaaaggtgctttggatatagcaggtcttccaggaaaattagctgattgtcaggaacgtgatcctgctttatctgaattatatcttgtagagggtgattcagcgggaggttctgctaaacaaggacgtaatcgtcaaaatcaggctattttgccattaaaaggaaaaatacttaatgtagaaaaagctcgctttgataaaatgttatcttctcaagaagtgggaactttaataaccgcacttggttgtggtataggcagagatgaatataatcctgataaattacgttatcatagtattattattatgaccgatgcagatgtagatggttctcatattcgtacattgttattgactttcttttatcgtcaattaccggaattaattgaacgtggtcatgtttatattgcacaacctcctttatataaagtgaaaaaaggtaaacaagagcaatacattaaagatgatgaagaaatgcaacagtttgagttaaatttggcattagaaggatcctctctttatgtaaatgaaaatgctcctgcaatgaacggaatagcattagaaaaacttatttcggaatataattcagtacaaaagatgattagccgtttatcttttcattatccagaaatattattgaaatcattaatttatcaaaaagcattaactaatgaaatgatgattgatgaaagtgcggttgatttttgggctaaatctttagttaatattttaactgacaaaaaaataagtggtagtagttacaaatatcgtattgtttttaacaatgaacgtcatttatatgaagtagttatcattattcgtacccatggtatagaaaaaaattattttttgaattttgaatttttaaatggaactgaatatagccgtattgttaaattaggtaaccaactacagggtttattagaaaaaggagcttatgtatctcgtggtgaacgtcaacaatcggtttcgtcttttgaacaagctatcgaatggctgacgaaagaatctcgccgaggtctgattattcaacgctataaagggctaggagaaatgaattcagatcagttatttgaaacaactatggatccaaataagcgtacaatgttaaaagtatcgattaaagatgctgttgcagcggatcaattatttaccactttaatgggagatgaagtagaacctcgacgtgaatttattgaaatgaatgcactaagagctaatttagatatttaattttattttttatttatcaattttggaattaatagaggtttttaatgtgtacagttatgcagaaagatgtattaattgaaatggttgctaatactatggctacgatcgatgtaagaacagaacctaatgcagaggataatgaggatcagaattatttgatgaacttaagaaatgatttgtatagtactcatcatgatgacattgattataatctcctatcaatgacagtaaaaaatatcaaaaataaatatataggtcagcctgttcataaatattatgcgtaggtgataagcataataaataagctcttgatttgtgtgaatattatttgtaaataaaaagatccccttaaaaagggggatctttatttttttgttgttctaaaaaattgatgttctttaattaacgcaagaaagggttgagcaaaacgttttaatttaatatcgccgacaccattaatttgtatcatttcttgttctgttattggttggtattgtgccatttcttgtaatgttgcatcgttaaatactatataaggaggaatattttctttgtctgctatttttttacgcaaaaaacgtaatcgagcaaagagatctttatcgtaatttgtgaccgctcttttgggtatagtaacggcattagtaatagaagatatccttggtgttgctaatttcaatggttgttcacctcgtaaaataggtaatgcctctaatgtgagttgtaatgttatattaaaatggtcaattacttgttttatcagacctaaatggattaattgtcgaataactgattgccaatattctctactacgatctttaccaatgccgaaaacgcttagtttatcatgttgatattctttaattttttgattttgggaaccacgcagtacagcaataatatacattgccccgaaacgttgccccactcgatagattgctgacattactttttgtgcatcaaccaatccatcatattttttcggaggatctaagcaaatatcacagttattacaaggtttttgttgatattcgccaaagtaatttaatagaactaaacgccgacaaatttggctttcagcaaattctcctatggattgtaatttatgtagttctatttgacgttgtggtatctctggtttttctaaaagtactttttgtaaccaagcgtaatctgcaggttcgtaaaataagacagcttcagctggtaaatcatctcgccccgctcgtcctgtttcctgatagtatgcctcgatacttcgaggtagatcaaaatgagcgacgaaacgcacgttagatttattaattcccattccaaaagcaattgttgcaacaacaatttgtacattatcatgttgaaaagcacgttgaacaaattctcgttgctcattactcatgccagcatgataagcttcagctgatattcctttttggcgtagactttctgcaattcgttcaaccttattacgactgttacaataaataattccacttttccctttttgttttgcgataaattgagaaagttgctccataggtttaaatttttcaactaaggagtaacggatatttggacgatcaaaactaccgatataaatatggggattagataatttaagatgaataaggatatcttgtcgggttgcctgatctgctgttgcagttagtgccattattggagcatcaggaaaacttgctttcaatcctcccaattgagtatattctgggcgaaaatcatgtccccactgtgaaatacaatgggtttcatcaacggcaataaaactgactttgcaatgagaaataaaatgaaaaaagctggttgttaaggctttttctggagatatataaagcaactttaattttcctgatattgctttattttgaaccaactgttgttgttcaaatgtttgactggaatttaaataatcagcatttataccatttgctaataactgatctacttggtctttcattaatgaaattagaggagaaatcactaaagttaaaccggagaaacaaagagcgggaatttgatagcataaggactttccgccacctgttgccataataactaaactgtcctttttagctaaagttgcttcgataacttccagttgtcctttacggaaggactgatacccaaaaacagaatgtaaaatatcaagtgcggtagatttttccacagaatcttggctaaaatctaccgcacttttttgttgcttccattcttcaactgacattaagaaaaactcacctgttcaccatgagccaaacaagcttgttctaaacattgccaaaacaattttccatcctgagcaatccattgattatttttaaaggcaaaatgaaaacctccagccttgcttgcaagccataattctaataatggttcttgtttatttacaacaatttggctacgatcagcgaaagtaatagtaaaaaccgaaccttgagtatcacaatctacatcacaaccttgttcttctaattgttcttctatttgcaaccaaacttgttcgatattttggtgatattctgctatgttcatgaagtttacctatcaataaaaaagaataacaaaagattataaagatttttataagatagtgatagcacaaaggcatttttaatggtaaaaagtgcaagttttttaattaacaaggacataagcaatgaaaaaaataatttcaattttattacttagtgcaatagcttttggtgtgtcaggttgtggtgttaaaggatcattatattttccagaaacagaacaaaatcaacaaaaagttaattcaaaattaaagtaatcaatatgtaaggataacattatggatttttttctatataaagatggacacttaatggcagaaaatgtctctgtgaaaaaaattgcagagcaatttggcacgcctgcttatatttattcacgagcaactctagagcgtcattggtatgcttttgataatgctttaggagatcaccctcatttaatttgttttgccgttaaatccaatcctaatatagccattttaaatattatggcaaagttgggatcaggttttgatattgtgtctcaaggtgaacttgagcgagtattatttgctggaggtgatcctaaaaaagtggttttttctggtgtggcaaaatcagaacaagaaattgcacgtgcattggaagtaggtattcgctgttttaatgtggaaagtgcggctgaattaataagaataaatcaggttgcaagaaaaatggggaaaattgcctctatttctttgcgagtaaatcctgatgttgatgctcatactcatccttatatttcgactggtctaaaagaaaataaattcggtgtaagtgttgaacaggctcgagaagtttatcgccaagcaagtcaattggaaaatataaaaattgtaggaatagattgccatattggttcacaactgacagaacttcaaccttttttagatgctacagatcgtttaattgttcttatggagcaattaaaaaaagatggaataacattagaacacgtggatttaggcggtggtttaggggtaacttatagtgatgagaaagcaccacatccaagtgaatatgctacagctttgctggaaaaattaaaaaattatcaagatttggaaattattttggagcccggtagggcaattaccgcaaatgcaggtattttactcactagagtggaatatataaagagtaatgaaagtcgccattttgccatcgttgatacaggaatgaatgatatgatcagaccggctttatatcaggcttacatgaatatcattgaagttgaccgcactttgtcgagagaaactaaaatatatgatgtagtcggtccaatttgtgaaacatcggattttctaggaaaacaacgctctcttgcaattgcacaaggagattttatcgtacaacgatcagccggtgcttacggtgcaagtatggcatcaacttataattctcgtccacgagctattgaaataatggttgatggagagcaagttaatttaattaaacgtcgagaggagtttgctgaattgtggcgtttagaaaaattactggaaatgtaaatttttctcgtaaatttcaactaactaaaattgagtttttattctgttgttacactgtgtttttggcaacaaaaattagaatataaaataaaacaatataaaaaactgaataattaaaaataaacaatatttaattccaattaaatataattaattaataaaaaaagatatttaatctaaatttttgttgttgactggataaaatattttgttatattgctaaaccttctgtaatgaaataaaaaatataaaaggtctataaaatgaaagatacaacacaaaagcgagaaacattttccggtcgtcgtgcatttatcttagcagcgattggatctgccgttggtttaggaaatatttggcgttttccttatactacttatgaaaatgggggtggtgcatttatcattccttatttaattgcgttattaactgcaggtattccattacttttcttagattatgctattggacatcgtcatcgtggtggtgcacctttatcttaccgtcgttttaacccgcactttgaaacgtttggttggtggcaagtattggttaattttattattggtatttattatgccgttattttgggttgggctgctagctatacctatttttcaataaataacttttggggagataagcctatagagtttttcctgaatgaattcttaaaaatgggtgatattactcaaggtgttagttttgaatttgtaggaatggtgacaggtccattaattgctgtctggctgattgctttaggaatattagcactaggtgtacaaaaaggaattgcaaaatcatcaagtattttaatgcctattcttgtcataatgtttgtaattctcgttgtttcatcattatttttgcccggtgcggaaaaaggattagatgcgttattttcaccagattggtctaaattatccgatcctagtgtatggattgcggcatacggacaaatatttttctcactctcgatttgtttcggtattatgattacctatgcttcttatctgaaaaaagactccgatttaacaggtagtggattagttgtaggttttgcaaatagtagctttgaattgttagcaggcataggcgtttttgctgcacttggttttatggcagcgacagcaggacaggaagttagtgatgtagcaaaaggaggaattggtctagcattttttgctttcccaacaattattaatcaatcaccttttggtgaatttattggtgtattattcttcggttctttaacttttgcagctttaacttcatttatttctgttattgaagtaattatttccgcagtacaagataaactaagaatacgtcgagtaaaagttacttttattgttggtttaccaatgatgttttgttcagtgattttgtttggtactactacaggtttaccaatgcttgatgtgttagataaatttgtaaactattttggtattgtagctgtagcatttgtttcattagttgctattgtttccaatgaaaaattaacttcattgggtaatcacttaaatgaaacatcttcttttaaagttggttttatttggcgtttatgtattgttttaacaacaggtattctagcttttatgttatttagcgaaggtgcaaaagtattttctgaaggttatgaaggttatcctgcttggtttgtaaatatttttggatggggtatgtcgttaagtttattagttgcagcattcttactttcccgtttgaaatggaaagatgaagcattaacacacaaaaaaggagaataaaaatgagtaacagcgctattatgatgatgatcatctctttggtaattatttggggtggtttagttgtatcaatattaagattacctaaagaatgataaatttcaaataaaaataccgcactttgatctgcactctaaaagatagggttaatttcccatctgattaaagtgcagattttttatgatttcatattaatagtagtaggttataaattccttaaccgtcatctattctcgcatgagtgatgacagtaaaattatgctgaaatagcaattttcaaggtgagttcatgggatgggtatcgatccatcattggtcatcatcaaccaagttaaacgaaaacagtatcacgagtgaggtggagttttttgataacatactctttggttaataactgatttaactttaataattttttgagtctagttttagttttgtgacaatgaaaaaatcccaaaacttgaaataaaaaatgattttatattgatttagtgatgaatcccctgcttttaaacaggggagggtgattttattgtaaaagtataatctcaacaggttttaatcctgccctctctagacctttattaagtttctttaaagcctgttctttttctgttttagtcaatacattgacattcttgtataaaagtgcggcagtaagattccaaaataaaatgagatttacaggaatacctgagagttttaactctatgtagcaatttgctgctccttttaatttaaaggattttatatctttaatgtgtattttagaaagaagcctttcgtgttttatcgaaagatttgggagatcttttattctttttttccgagcaagttcttgtgcaattttctttgctctagtttgagcaatagatagatagagaatttgacgaaaatgttccttattctgtgtaatttcttttggcaatagataataatttcctatatttagttgagggtttggggttaaagctaaatatgataaagcacctaggctttctaggtatttagctaattccttctctgctcgaatataaaattttccttgctggtataaaccaaacataagacctttcttaaataaaccataaccagaaaaaagatttttcacagttatagttcctatcaattcggtaagttcacttctaatattttcagtgtcttttaatgatttggtcatatataattcaacctcatttattgtgacaaaataaataaaaaccttttgattagaaaaaatctccaatcaagataagttataacacagagagtggattttattttaaataactttctaattttgttaaagtttgtgatagagatcgagaatttataaaaaagtttgctattttctttagattttttagagaaatgataaaatatgccaccgatggtttacattattattataattgtttaataactaaacaaaaagattaaaaaaagagaaaattaatcaaattttgataaaaaatataaaaaaagcttgcattgaactataaaatgcctataatgcacggcacacaacgacacgctgttgtgagaggttaagcagtgtgtcgttattttttgttctttaacaaactatcagacaaactgtgtgggcacttgtgaaactgtattaataagagattaaaagagtaagataagtgcttaaactagagaaattcatagagaaaagatggataaaatagtcagtatttattgagcgaagagattaaattgaagagtttgatcatggctcagattgaacgctggcggcaggcttaacacatgcaagtcgaacggtaacggggagggagattactttctctgctgacgagtggcggacgggtgagtaaagcttgggaatctggcgaatggagggggatagccacgggaaactgtgggtaataccgcgtaatgtctaaggaccaaaggggtgggactgtgaggccacctgccatttgatgagcccaagtgggattaggtagttggtgaggtaagggctcaccaagctgacgatctctagctggtctgagaggatggccagccacactggaactgagacacggtccagactcctacgggaggcagcagtggggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttttgcatagaggaagaagcgggacaggatagagagaggaatacttgaagtagaggcttgtttttttattgaagaagagatagagacgggatataagagagaggaatttaacttggcggcgatagtgcggtgggaccacctgacaccatgccgaactcagaagtgaaacgctgtaacgccgatggtagtgtggggattccccatgtgagagtagggcaccgccaagttttttatgttatgaccctaagtggagacacttagggttttttgttatttgggataaggcggggaagagtgaagagggaagaggaaaatgggagagaaaaggtaataaggtgataacaagggagtcataaacagtaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttatggacagatataattgctaatctacttcagatcattgtaaatttgccttattgtcttattaccttgtaggtaaaagtgcgattaaaaagtcatatgtttctttagccaatgaattactgtatgaatgttttgattgtgtttgtaaggtgttacaatataataacgctgattacacggtttttctaagcctttgaaaggggttattaattggtcattaactaaataaggtgtgattaactgttttctccccattgcgatgccaatatggttaattgcagctgttaatgctaaattcgaacagtcgaataccatggactgtacttggtttaaattaagactgtaattgaaatatgttaaccaactctcccattcttcaaaatcggaattgtaatgccacgcttgtccgtcatgaagcaatagacagtgttctaaagatttcggattcccataaagtttatgtttctcggcatattcagggctgcaaaccggaataacgctttctggcatgagttcatagtgatgtaaattttcactatataaatcatcataatagatagctaaatctactttatacctattgaaatcaataacttcattgccagtcaaaatattcagtgtgataaacggatatttttgattaaatcctgctatagcaggaataagccaactttgagctaaggaagggcgagcataaattgtcaatgtgccactgatttcttgattacgtatttcaaaaatttctttatttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccagcaaagcccgcacgctttcgtctattaagatagcccgcctatctgatgaacaagcgtttagcttattatgcgagctacgctggggggagtaaggaaaatgtgggttgcccgaaatgtggtgtacaacatcaagcctatttcatctctactcgcaaacaatggcgatgcaaacattgtaaacacacctttagcattacatcaggcacgatttttgcgaatcataaattaccaattcaaacctatttattcgccattgccttattcgtcaatgcagttaagggaatttccgcctgccaactctctcgtgatttgaatgtacagtataaaaccgcttttaccttatcacataaaatccgtgaaagtctgattgtacagcgtgagctttttcccctttcaggtgaagtgcatattgacggcacttacgtgcattccgctccacgtccaaagaataagaaaagtgaacgtgtcgatagacgcttaaaacaaatgccaatccaaacaaacgtgcggtattggttatgcgtgaacgttattcagaacaagatactttaaacaatccaaatcttgttggagcaaagaaaaccatcacttttcctattttgtcagaaaacaccgacaccgtgaagaaattggcaaccgcctatattgagccaaatagctgtattcatgcggatgaaaatagtgcttatgatgaattgatagtagattatgacttacaacgtgtgaatcatcaaaaagaatatcgtagcgataatggcattaccaataatctagcagaaagctattttgctcgttttaaacgcatgtattacggacaagtccataaaatgtcaaatatctatcttgagaactatgcaaacgaaatagcttatcgggaagatactcgtaaactggataatttaacccttttcaatgatatcaccagtaaatgcctttctacaccatcagaaaacgcttggaaaggctattggcaaggtaatcacagacaagtagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatacgaactcgagatgataagtcttgaacagcatgttcccaaagatcatcttgtgcgtaaaattgataaagcaattgatgttaaatttattcgtgatgaagtcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcatttgttgcgtattatttgcttggtataaaacatcaccaaagtatggaatccttattaaaaaatactgaaaatgggtttatggctattggtaatattttactgattataggtgccggaggggcatttaacagtattttaaaggcgagcggattaagtgatggattggctgagattttagcaaattttaatacacatcctattctattggcatggcttgttgctattgttttacatgccgcagtgggttctgcaacggtagcaatgatgggagcaacggcaatcgtgtcgccattacttgttacttaccctgatattagccccgaaattattgtccttgctattggttctggtgcgataggatgcactattgtaacggattctctcttttggttggtcaagcaatattgcggtgcaaccttgaatgacatttttaaatattataccggtgcaactttcatcgcttccgtattagcactcgggtttacatttttattatcaacagtgatttagaggtatcattatgaaaattcaacatttaatgcaagatcctttcattcaaaaattaatgcgttttgaagaagtgatgtggtttaatcctaaaagtgcgggggtaaaaacaggattgtcttacgttgggttggatgtatccgatactcaacaggcggcggaacgtttgcagcgttttgctccttatttttgtcgtgcttttcctgaaactcaaaaaacgaaaggtattttagaatctgaactggtatctattgataagatgaaatcggcattaatcgatcattatcatatgccaatacaaggacgtttattgctcaaaaaagacagtcatctaccaatttcaggatcaattaaagcaagaggcggaatatatgaagtgttggcttacgcagaaaaattggcattagaacaccatttaattaccgaaaatgatgattatagtcaattgtgcgatgaaaagatcaaagattttttcagccgttatagtattgcagtaggatcaacggggaatttggggctttccatcggtattatgggggctgtactcggcttcaaagttagtgtgcatatgtcagccgatgcaagagaatggaaaaagcaaaagttgcgttcatacggtgtgaatgttgtggaatatacacaagattacggtgtagcggtcgctcaaggacggaaggcagctctttccgatccgaactgcttttttattgatgatgagaattcgacaacactttttttaggttattccgttgtaggtcaacgactaaaacaacaatttttggaacaaggtataaaagtagatgaaaatcatccgctctttgtttatcttccttgtggtgttggcggtggacctggtggtgttgcattcggattgaaattggcatttggtgattatgtacactgcatttttgctgaaccgactcattcaccttgtatgcttctcggtgtttatacagggttacatgataaaattgctgtacaagacttgggtattgataatatcacagctgctgatggtttagcagtagggcgtgcatcaggatttgttggtcgggcaatggaacatttgttagacggtttttatactattgaagatcaaaagttatatgatttactggggctattgcataagacagaaaatattcaacttgagccttctgctttggcaggaatgataggtccgttgcatatcaatcaccccgattatttaagaagatatcacatcacacaagaacaattggcaaatgcaacacatatagtgtgggcgactggtggtggaatggtacctgatgttgagatgcaaaaatatttgtcactcgggcgattttaaaatattctccccaagttggtttttggggagaagaaagagtgcaagtgcggtagatttttagagagtactggaaataaataataaatttgatgcgtcactattttgtttatttttaagtgcattctgatttatttgcaaacatattgcctgttaaacaagcaaacaattaagattttgtaattttttaaaaattattgttgacttaaataagaaaaaaacgtttaatacgcaccactgacttgttgcctcgatagctcagtcggtagagcaggggattgaaaatccccgtgtcggtggttcgattccgcctcgaggcaccattctactcctccttagttcagtcggtagaacggtggactgttaatccatatgtcgctggttcaagtccagcaggaggagccaactctatgttagttatgttatagaaggatgccttattgattattgttttgttaagagggtatcaaatagaaagtcaagaatttatctaaaaaatagattttcccaatttaaatttaattcattttaatagtatcaatcattcatattaaacttaatctcttcaggacatggtagttccgcctttcagtgttccctatgctaatatctgcatcaacaagcacaagttatattgcttgtaatatagaaatagtgcatttgcaatgcttgcagaactaatgttggtgaggtgtgaaaaaatgggtaatgatgaaggtatatttttttcaaagaaaattaaaaaaattaaacgttaaataatgcttaataataaaacaaaagtgcttttcttttgttaatttggtaaagtatatacatcaaaattcaaattaattagttaaaaattaagaaaaatgatatgtatacatcaaatttcactaatttaatcttaaatgtagacagctataaagcatcgcattggttgcaatatcccaaaggaacagaatatatttcctattatattgaagctcgtcgagaaagttttgatgtagtgatgttcggtttacaggcctttatcaaagaatatttgcttaaacctatttgccaacaagatgttgatgaagcagaaattgtattaaaagcacacggattgcctttttatagagatggttggcaacatctaatacataaacatcaaggttatttacccttaaaaattgaagctgtaccagaaggaacggtcttacctgttggtaacgtggtttgtcaaataaccaatacagatcctgattttttttggttagtcggctatttagaaaccgcacttttaagggcaatttggtatccttccactgttgcaagtctttcctatttttgtaaaaagcaaattagacaagctttaataaagtctgcaaatgatttatccggtttagactttcaattacatgattttggtgcacgaggtgcatcaagcctcgaaactgttgcgttggggggattagctcatttagttaatttcaaaggaacagacagtgtttctgctttaattgctgcaaaacgctggtataacattaatgaaatgcctgcattttctattcctgctgccgaacatagcactatcacttcttggggtaaagatcgggaaataaatgcttaccaaaatatgattgaatgctttggtggagagggaaaactttattccgtagtatcggatagttatgatctttggcatgccttggaacatatttggggcgagaaattaaaagatttggtgatcgaaaaaggtggaagattgattattcgacctgacagtggcaatcctatagagattatttgcaaaaccctagaaattttagcaaataaatttggttatattcttaatcaaaaaggctacaaagttttacctgattgtcttcgcattatccaaggagatggcatcaatgctcaaagtctaccaaaaattcttgatgctgttatgcaaaaaggatttagtgccgagaatgttaatttcggcatggggggaggactgctgcaacaagtcaatcgtgataccatgagttgggcaatgaaagctagtgccatttgtattaatggacagtggcaagagatttataaggatcccattaccagccaaagtaagcgttctaaaaaaggtattttggctttagtcaaacagggaagtgattggttaacaattaaacaatctgagttaaatggacaaactaatcagttacaaaccgtttttttcaatggaaaactttttatcgaagaaaacttaacggaaatccgcttgcggaccacgtcctttttagtatgaccatattttacacagtgagaaaaagatgatatttgaaaaagtatcatcttttattttttgcttaacaatgtacttactattttctagctagtggtggtacaaatgtaattcccatatcccaaggctgttcaatccacgtattttgtggaatgtcaataacataatcatcaactaaattagccccagcaggtttggcaaaaacagtaacaaaacgcgcatttgggtagagttcacgaattgctcgagcagtatttcccgtatcaactaaatcatcaactacaataaaaccttcgccaccattttttacctgtgccgcatgcaaaacatttaaattgccttgctgattatggtcataacttgaaatacaaacagtttcaatatgacgaataccaagttcacgagcaataactgcagctggaaataatccaccacgactaacggcaataatacctttccattgtgttgccggaagcaaacgttctgataatttacgtgtatgcatttggaacatgtcccaagttacaacatatttttcgctcataattcaccctaaagtcagttgatagcggagttccgcctgagaaataaaatggcgttagaataacctgaaatctatttttatgctattattttccttatttttcgctaataaaggataaaaaattatgtcagatcttcaatctctgcaacctaaactactttggcaatggtttgatcaaatttgtgctattccacatccttcttacaaagaggaacaattagcacaattcattattaattgggcaaaaacaaaaggcttttttgccgaacgtgatgaagtcggtaatgtattaattcgtaaaccggcaacgacaggaatggaaaatcgtaaacctgtagtactacaggcacacttggatatggttccacaagccaatgaagggacaaatcatgattttgatcaggatcctattttgccatatatcgaaggtgattgggttaaggctaaaggcacaactttaggcgctgataacggtatcggcatggcatccgcacttgctgtcttagaaagtaatgatattgcacatccggagttggaagtattgttaaccatgactgaagaaagggggatggagggggcgattgggctacgtccaaattggcttcgttctgagatcttaattaataccgatactgaagaaaatggagaaatttatataggttgtgccggcggtgaaaatgcagatcttgaattacctattgagtatcaagtcaataatttcgaacattgctatcaagttgtgttaaaagggttacgaggcgggcattctggtgtggatattcataccggacgagctaatgcaatcaaagtgttgcttcgttttttagcagaacttcaacaaaaccaaccgcactttgacttcactttagcaaatatccgtggcggttctattcgcaatgctattccaagagaaagtgttgccactttggtctttaatggtgatattaccgtattacaaagtgcggtacaaaaatttgcagatgtaatcaaagccgaattggcactaactgagccaaacttgatatttacacttgaaaaagttgaaaaacctcaacaagtattttccagtcaatgcacgaaaaatattatccattgtttgaatgttttgccaaatggcgtagtacgtaacagtgatgtcattgaaaatgtggtagaaacatcattaagcattggcgtgttaaaaactgaagataattttgttagaagtactatgttagtgcggtcattaattgaaagtggcaaatcctatgttgcttctttattaaaatctttagcctcgttagcacaaggtaatatcaatttatcaggcgattatccgggttgggaaccacaaagtcatagtgatattttggacttaactaagacaatttatgcacaagttttaggtacagatcctgaaatcaaggtaattcatgcgggacttgagtgtgggttattgaaaaaaatctatccaacgatcgatatggtatctatcggaccgacaattggaaatgcacattctccggatgaaaaagtacatattccggctgtagaaacttattggaaagtattaaccggtatacttgctcatattccatcacgttaaaaattgatatacaagacaagtataaagagcggtgtaaatttgcaaagaattgagcaagcacattagataactttatcattcttaaaactaaaaatccttgtagaaaatcgttttttacaaggatttttgtgtcgaacaacaatctatttaattcaacattttctttaactgatataaacactcaagtgcttgcttcggacttaactcattaggatcaagcgtttttagcgtttcaatcaccgcacttgtattctcctcctcttccattaaagttaattccccttgaacttgtgtcaaaacggattgtgattggtaactgttttgctgagaaagtgtttcaagctgttttaatttctgttttgccgatttaattacattttgtgggacaccggctaaagcagcaacagccaaaccataacttttacttgccgcaccttcctgtaccgagtgcataaaggcaatactgtcgttatgctcaaaagcatcaagatgaacattatggataccgtcgattttttccggtaatcctgtcagctcaaaataatgcgtggcaaataacgttaaactgcggattttttgagccaattgttcagcacaagcccaagcaagagaaagtccatcataggttgaagttcctcgcccaatttcatcaataagcactaaactttgctctgtggcttggtgcaaaatatttgccatttcagtcatttcgaccataaacgttgaacgtccggatgcaagatcgtcagaagcaccaatacgtgtaaaaattcgatcaataggtccgattaccgcactttctgcaggtacaaaactaccaatatatgccattaaagtaatcaatgctgtttgtcgcatataagtacttttaccccccatattcggtcctgtaataatcaacaaatgacgcttttgattaagttctacagggttagcaataaaggggtcttttaacacttgctctacaaccggatgacgaccctgcattatttgcaaaccgatttgcgtactaaattgcggttgaacataatttaaggtttccgcccgttccgctaaattggttaaaacatcaagctctgccaacgttaaactggctagttgtaaatcacctaagtgcggtaataattgatcgaaaatttcatcataaagttgtttttctaacgcaagtgatgctccttttgctttaaggactttttcttcataggtttttaattcaggaataatataacgttctacatttttcaatgtctggcgacgcacgtaatgaagcggtgctttatgtgcttgcccttgactgatttgaatataataaccatgcaccgcattaaaaccgatttttaatgtatcaataccagtatttgcacgctcacgttgctccaaatcctttaagtagcgtgttgctccttcagacaaactccgccattcatcaagctcctcgttgtaaccttcagcaatgacacctccatcacgaataagtaaggggggattatcaataattgctcgctgcaaaagtgctaattgcacagaaaaatcagcaatttgttgtgaaaatgcaacaaagtgcggtatttttgttaattggtgttgaataaaaggtatttgttccaacgctgttcgtagccgagttaaatctcgaggtcgagcggaacgcagggcaacccgagcaagaatacgctccatatcgccaacttgacgtaaaagaggttgtaattcttcaactaaattttgctgcaacagcatttgaatatgttgttgacgacactgcaatttttcaatattgcgaataggctggtgaatccaacgtttgagtaagcgacttcccatcggggtaacacatttatctaaaattgcagcaagtgtattttcagttccgccagcaagattttgggttagttctaaatttctacgtgttgacgcatcaatttgtacagtatcgctattttgtaacaagctaatactttgaatatgaggaagtgcggtacgttgtgtttcttttgcatattgcaacaagcaacccgcagcacataatcctaaaaccgctttttctacaccaaaaccacgcaaatcttttgtaccgaattggcgattaagtaattgaattgccgtacttaattcaaactcccaaagaggacgacgacgtaatcctttgaattgttcaattaaatgtttatcctctaacgcttccgaatatagtaattcaactggttgaatacgttgtaactcagcttgtaaactggcggcatcttgtagttcgctaatttgaaaacaccctgaagtcatatctaaaacagctaagccaaattgtgttttttcttgataaatcgtagcgataagattgtcttgtttttccggtaacaatgcttcatcactcactgttcccggtgtaacaatacgtacgacttggcgttcaaccggacctttagctataacaggctcaccaacttgctcacaaatcgctacactttccccaagttgtaccaattttgctaaatatccttctattgcatgataaggtacgccagccattggaaccggttgtccagctgattgccctcttttagttagggaaatatctaataattcagcagctttttttgcatcatcataaaaaagctcataaaaatcacccatgcgataaaacaacaaaacatccggattttccgcttttatttttaaatattgtttcatcattggcgtgtgattttcgaatgtgtgcatggctttcattgtgttaataagtaaaaagaataagtggaattataacaaaagtgcggtctgttttgctggtgttttttgtatctgctttcaagtcaaaagaataaaaatatgtctaaatgatcaagcggttgctcctgccttttatatttttatctcgtttccactaaataaagggtcaatttccggcattacgccacgccataaataaaatgcgtgagcagcttgcccaaccagcataccgaagccatcgctaattttggttaccccttgttttttacacaatgcaataaaaggcgtgtcgctttctttgctgtattgcatatcataaacggcagaggcaagttgtaaaatctgaggatcaatatcaatagttttaccttgtaatcctgttgatgtagcattgatgattaaatcaaatgtttgtatcggaatatgttccagatccaacgcttcaatggtgccaaaatgattgaatttatgtgctaagtcttcagctctactaaaagtgcggttggtaattaagatattttgttgagcttgtaataaaggcaataaaactccttttgtggcaccgcctgcgcctaaaatcagtattctttggtttggtttgagccaatttaaacgttgtaaatcgctcactaaaccggcaccatccgtattatcagcaaataatgttccatcagctaatttttttaaggtgttacaagactccgcacttaaacaacgcttgctatgttgttgtgccaatttaaatgctcgctctttgaaaggagcggtaatattgcagcctttagcaccttgtgcaaaaaaatcgctcaactgttgttcaaatttttcttcatcacccaatatcgctacataatctaagttttgtcgagtctgcttcgcaaaatatcgatgaagttgaggagatctactttgagcaatgggatttccccaaactgcgtatttatccattttttatccttgtctaactaattgattagtaaataaatcacgaatttcagatggttttgtggctgagccaactgacatatccaatacaggaaaatccgccccgaattgtaacctgacttcatcgctggttttgcaaggtgcaatcccacttaaattggcactggtagaagttaaagcaaaacctgtttgttcgcaaagtattttgatggcgggatgttggcttactcgaatagctatactattaaaattgccacataagaatttagcaatatctttttttgccggcacaatccatgtaatggggcgaggataagtttgttgtagtttttgccaatgttgagaattgatctgttccttatcaataaaagaaaaaaaataatctaatttgggtgcaactaaaattaaacctttttctcttgggcgttgctttaaaattaataatttttctaccgcactttgactaaaagggttgcaacctaaaccgaaaacagcctctgtcggataggcgacgacttcattttgtttcaatttttcaataatttgtgtgatattcatattgttgttttgaaaatatgttgacaatttttattgatacacaaccaagtgcggtgattttcgtctttttttttcaagattgcaccttgcatttggcaatgggggcaagggattaaatgaggtttttgtgctaaggtaaatttgcatttcgggtactgattacaagcataaaaattttttccttgccgtccatgtcgagcaacaatttcaccatgttgacattccggacaaacaatctgttgttctgtcgtttcttgttcttcatgcacgacaaaacgacattccggataaccgctacaaccgataaacatgccgtaactaccctgttttagttgtaaaaaacgaccgcacttcggacaattttgagcaagatttttaagtattttactttcattattagggtgtaaaggcttgatataatcgcaagatggatagttagaacaacccaaaaacaaccctttttttccttgtttcatctgcaaaacagcttcacattgaggacaatgttcttgatgtttggtatgttggaaaaggctttttgacatattcttttttcaatccttgtgagaaaaaacaacaataaacgatcctatcaataatatcaacttacaatcctaatttgaaagccattctagcacagtgtagaatgtgcaacattgtatttaggataagagttttatgaatttacaagatcattttttgattgccatgcctcatttagaggacgagaattttcagcgttccgttgtgtatatttgtgaaaataatgaacaaggctcaatgggattagtgctaactcaagcaacagatttaagcattgctgaattatgtgcaaaaatgaattttatgatggcggatgagcgtgaatattccgataaattagttttattaggtgggcctgtaaatttagagcatggttttattttacataagaaaacagcccaagaatttcagcatagctataaagttacagatcaaatttatcttacaacttcggcggatataattaatacttttggtaccgcacaatcaccggaaaaatatttggttactctggggtgtgcaagatgggagccgaatcaactggaaaatgaaatagccaataatgattggttggttgtgcctgccaatgaaaatattttatttgatgtgaacagttcggaacgttggtttgccgctaatcaattattaggtattgagcatgtaaatttttcgtatcaacaacaaatggaacatagttaatgtcaattacagttttagcctttgattttggcacaaaaagtatcggttgtgctgtagggcaaagtataacaggtacggcacaagcactcccagcatttaaagcacaagacggtatacctgactggttaaaaattgaaaaatgtttgaaagactggcaacctaatattgttgttgtcgggttacctttaaatatggatggtagcgagcaagatctcactcatctagcgagaaaatttgctaatcgtttgaacggtcgatttggtgtgaaagttgaattacaagatgaacgcctaaccaccaaacaagctcgtgatgaaatattccaacgaggcggttaccgagctttaaagaaagaaaaagttgatagtatttccgcctgtttgatcctagaaagttggtttgaaaacggagcttatgaaaagtaatcacactaaaattaggtcaatttccatttcttttatcgattcttgagcatttagtaacagtttgtcatcgcaaataatgctattgaatacgcttaattcacaaatagaaaatgtagctgtttttccatatttagaagaatcagataccaaaattttgttgtaactggattgcaatattgcttttttaacaggcagttttttctcatccggtgtagttaagcctcttaaattccaagatgatgtggaaataaatgccagatcaattgaaagctgtttcaataactgtgtagccaattcaccaacagaggagaaattagatttattaattgatcctcctgtatgaattaattcacattgtccatgtttcatcaagaaattagctatcacaaaatcatttgtaatcaccaacagatcttctcgttgagcaatattatgtgcgatttctaatgttgttgttccggcatctaagtagatagttgtatttactggtattagctcagccgctcgactaccaattttttctttttgtagcgtggaaagcaaagatttgtcattgtgtgtcggttcaataaataaatgttctaataatttcacaccgccggaaactgaaacaacaataccttcttgctctaatttttgaatatctcgacgaacagtcatatgagatacacctaataattttactaattcattgatactaataatctcttgcttactaatcagcttaagaagttttttttgtctttctgccggtatcattttttactcctgattttttacataattatatcactttttccatttaggctaatatctataaaattaacattatttaacaaataatgttaaataatgtgatcgtgatctcattttttttgtaaaaaaaagtgcaaaatacaccatcaaataactttaaaggagtgatcagtatgaaccaaaaactattttctgtcgctgttattggtttaggtgcaatggggatgggagctgcaaaatcatgcattcaagcaggattagatacctatggcgttgatttaaatttacaagccttagagattttaaaaacagctggagcaaaacaagtgagtacaagtgcgataggttttgcaaaagatttagatgcagttttgctattagtcgtcaatgcaaatcaagtaaataatattttatttggggaacaaggattggcacagcatttaaaacctaaaactgcggtaatgatttcatccactatttctgcacaagatgccaaagaaatttcacaaaaattaacaaaacttgatttgataatgttagatgcacctgtatcaggtggagctgcaaaagccgctcaaggtgaaatgacggtaatggcatccggatctacagaagcttttgagaaattaaaaccggttttagacgcagtttcaggcaaagtgtataacatcggagaagagattggtttgggtgcaaccgtaaaaattattcatcaattactggcgggagtgcatattgctgcaggggcggaagcgatggcattagccgcaaaagcaggtattccacttgatttgatgtacgatgtagtaactaatgcagcgggcaattcatggatgtttgaaaaccgaatgaaacatgtggtagatggcgactatacgcctctctccatggtcgatatttttgtaaaagatctcggtttagtgaatgacacggcaaaatctttacattttccacttcatttagctagcacggcttattcaatgtttactgaggctagtaatgcaggctacggtaaagaagacgatagtgcggtaatcaaaattttcagtggtcttgatctaccgaaaaaaggaggacactaagatgttaggtgtcatagcagatgattttactggtgcaagcgatattgcgagttttttagtcgaaaatggcttaaaaacagtgcagatgaacggtataccaaaaaccgcacttaacagcaaagttgatgcaattgtaattagcttgaaatcacgttccaatcctgttgaggaagctatccaacaatcgttacaagccttagattggctaaaacaaaatggctgtacccaattctatttcaaatattgctcaactttcgatagtactgaaaaaggcaatatcggaccggtaacggatgcgttaatggctgcattagaaactgattttactgtcattactcccgcacttcctgttaatgggagaactatctttaatggttatttgtttgtaggtgatgtattgctgaatgaatccggtatgcgtaatcatccgattacaccgatgaaagaggctaatttagttcgcttaatggacgcacagtctcaaggtaaaactgggttattgacttatgcagatgttattcaaggtgcagagcgtgtgaaagtacgttttacagaattaaaacaacagggctataaatatgcagtagtggatgcggtagataattcacagcttgtggtacttgctgaagccgtggcggattttaaattggttaccggcggctcaggtttgggggcttatatagcagcgtatcgctcaggcggtcagaaaggaacgaatgcctttgtaccgaataaaggcaaaacggttgtgctttcaggatcctgttctgtgatgacaaacagccaagtcaatgcgtataaagcccaagcaccaagttatttcttgcaagccgagcaagccattaacaatccaaattatgtggaagaactttatgcgtgggttgttgaaaatctaaacggcaactttgctccgatggtttatgccactgtaccgcctgaaaaattgaaagaaatccaacaccagtttggtgggaataaagcaagccatgcgattgaaactacatttgcaaaacttgcaaaaaaattgaaagttgcaggggtaactaacttcatcactgcaggcggtgaaacatcgagcattgtagtccaggagcttgctttctctggttttcacatcggcaagcaaattgcacccggtgtgccatggctacaagcagtcgaagagccaatttttcttgccttaaaatctggtaacttcggtaaagagaatttctttagttttgcacaaggaatgtgtgtatgacagaacttgaacaaaaacaacaaatggttgctttagctcgttcattatttgagcggggatatacagtaggtggtgcaggcaatctatccgtgcgtttagataaaaaccgtattttagtcacgccaacaggttcttcactcggacgtttagaagcagatcgactttctgtgttagatatgcaaggaaatgtgctttctggtgataaaccgtccaaagaatcggttttccacttagcgatgtatcagaaaaatccgagttgccaagcgattgtacatctacattctacttatttaaccgcactttcttgtttggaagatttagatacggaaaatgcaatacgagccttcaccccttactacgtgatgcgtatcggcaaattacctgtaattccttactatcgcccgggcaacttcaatattgccaaagaattaggcgagagagctttagacggcaaggcttttctgcttgcgaatcacggagtggtagttacaggagaaagcctaatagatgccgtagataatactgaagaattggaagaaaccgccaaactctattttattttacaaggtcaaaaagtgcggtatttaaccgatgatgaagtcaatgacctgaaacacagaggaaaataaacatgcccaaatttgctgcaaatttaaccatgatgtttaacgaagtcccttttttagaccgttttgaagcagctgctactgccggttttaaatatgtggaatacctttggccctatgattatccagcagatatgctaaaggaaaaattagataagtatggtttacaacaagttctatttaatacttcagcaggcaatgtagacgccggcgaatggggtgtctctgcgattccgggtcgtgaagcggatagtcaccgtgacatcgatcttgctcttgaatatgctcttgccttaggttgtccacacgttcatgtgatggcggcagttgtaccgcaaggcgaagatcgagaagcctataaacagactttcatcaaaaatgtgcaatatgcggcagataaatttaaaccgcacggtattaaagtcttattagaagcactcagcccggaagtcaaacctaactacctgctgaaaagtcaattcgacacgctagaaattgttgaatccgtcaaccgagataacgtctttgtacagttggattatttccacgcacaaaacgtagatggcaacttgtctcgcttaaccgacaaactcaacggcaaatttgcccatatccaaattgcttccgtgccgaatcgccatgagcctgatgaaggtgaaataaattaccaatatctctttgataaattggatcaaattggctatcaaggttttattggctgtgaatataaaccacgctctgacaccttagcaggtttagattggtttaaaccttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaaaaagccctatttttcatgggtagggctttttgcaccctgcaaacccaaaattgcattaaaaacaagcggtttttgtttaaagtgcaatctattttaaggagaacacaatgaaaattgttattacaggaggacaaggttttttaggacagcgtcttgcaaagactttgttatccaattcaactttatcaatcaatgaattagtgttgattgatgtcattaaacccattgcaccaaacaatgatccacgtgtgcgttgtttggaaatggatttgagaaatcctgaaggtttagatgaaattattaccgaaaaaacaaccgctctttttcacttggctgcaattgtgagtagtcatgcagagcaagatccagacttaggctatgaaatcaatttcttagcaactcgcaatttattagaagtttgtcgaaaaaataatcctaaagtgcggtttattttttcaagttctttagcggtgtatggtggtaatttacctgaaattattcaagatcacaccgcagttacaccacaatctacttatggttctcaaaaagcaatgtgtgagttattgatcaatgattattcacgcaaaggctttgttgacggcattgtagttcgattaccaaccatttgtattcgtccaggaaaaccaaacaaagcagcctcttcttttgtaagtagcattattcgtgagcctttacagggtgaagaagccatttgtccggtttcgtcagatttacgcctatggctttccagtccaaataccgtaattaataattttattcatgcgttaactttgccatcgctaccacagcgtagttggcacattattaacttaccgggctttacggttagcgtaaaacaaatgttatctgatttagcttcaataaaaggtgaaaacatcttagaaaaagtgcgatttgaatttgatgaaaatatcaataacatcgtcgcaagttggccggcagagattgataataaaactgctcttaaacatggctttaacgtggatgctgatttcaaagaagttattcaacaatttattaaaaacgatatgtaacttaggagcaacagtatgtttgacttaccaattccaatcattggactattgattgcggtatttgtcttagtctatttagtgttaaaaacacgtgttcatgcatttattgctatgctgattgcttctgcgattgccggccttgttggcgggatgtccgttaatgaaactctcggtgccattagtaaggggtttggtggaaccttaggcggtattgktattgttatcggtttaggggttatgatgggaagcgtgcttgaagtttcaggggcggcagaaaaaatggcttacagtttcatcaaactgctcggcaagaaaaaagaagagtgggctttggcaattaccggttatattgtaagcattcccattttcgttgattcagctttcgttattctttatccagtggctaaagcattggcaaaaaacggaaaacgttctcttttaaccttaggcgttgcacttgccggtggcttagtggtaactcaccatactgttccaccaacacccggtcctttaggtgtggcaggcttatttgctgttgatattggtgctatgttgttagtggggatggctctcgctatattgccggttattggcattgttctttacgcaaaatggctagataaaaaatatccggaatttaaccaacaagttttcactcaagaagaattgaaacaaaaatacgatgactatattgaaagtcgtgagaaaaagaacttaccaagcttagggttatccttactgccaattgttttgccaatcgttctgatctttatcaaagcaatgtttgatttagctgcaaaaggtcatgcggaactggctcaaatgggagtttatcaattctttgcttttgttggtcacccaatgattgcattagcaatcagcgtattagttgctgtttataccttattaccaaaagcagaccgtgattcgaccgcacttcatctcgaagaaggagtcaaaactgcgggaattattttattggtaaccggagccggtggtgcattaggtgctgtgctacgtgacagcggtgcaggtaaacaactagcggaacaaattgcttcattgccaatttcaccaattcttattccgtttattgtttcaacccttgttcgctttattcaaggttccggtacagttgcaatggtaacggcagcctcaatatccgcccctattttggctcaaattccaggtgtgaatatgttgttagcagcacaagcagccacaatgggttcattattcttcggttactttaacgatagcttattctgggttgtgaaccgtatgatgggcatcaatgatgtgaagaaacaaatgatagtttggtctgtgccaaccacgattgcgtgggggattgggggtatcagtgtgattctctgtaaccttgtctggggtaacgatggctcattatttgatcttttgttccctattgctgtaatggcaattattgcattctacatcaagttccaaaatagaactttgaataaataatcaacgcgcaaatagactatgaatgttattcgtagtctattttttaatctaaatgaggagtgaatatgaaaaaatattttattttggctagtggtttgctgttgtccactttggcctgtgcaatacctgatgaaattaaacctaattccaatgtgaatataactttgctcgcagaagtaaccgcacaaggatggagtaaggattgcctatcatcatttctattactctattaaattcttcatagaatctatgatttagagtgataatctgctgagcgtaaaggcttagtgtttcttgtgcactgtctaaatgattcattttcttccctcacaagagattaaagctcatcaaaattttgaaatttacgcaatgataataaccccatatttgagcaccaaataaaaaatcactcaaatataattgacaaccattattattttattttaatgtgaatatgctgtagatcgttatagcaaaattatcaattaacaaaaaactataggaggcaactatgcgtggacgtcgactaaactaattctataaaaaattatagaggtaatctaattagatcgcttctatttatcctctatataaataaggaagcatctatgaaatatatcacttctaaacatgtattttttgactatctaaatgaaaatgaatttgttattgggataggtagtaaccaagaaattacaaacaacaaagattattttaataattgtctaaatttatgttatttttgtataaatcctaagagcatttctgaaatattatcttttataaaagataataatatagacattctatatttcgataaaatgaagaaaatgaagtttattacaaaagaaataatagacttcaatgatagatacagtagaaatcatttatactataatgcattaggatataaaatatatgatatacaaaataaaatatctaaatctcatattcttattgttggtgcaggaggcataggaaatatttgctcctatttattaggaacaataggaattaagaagttaagtatcattgatgatgatatagttgaggaatctaatctaaacagacagttcttatttcgagagaaagacataaacaaaaataaagtagaaacaataaaaagagagttattatctattcggaaagatattattattgatattttcccagagaaattaaataaatctattttagataaaatatcacaaatagatttagttatttgttcagcagatgatgagtattgtatagatatgattaatgaattttgctgttttaataaaattcctctaattaacgtaggttacctcaatgatatttctgttatcggaccattctacattccaaagttagaatatagctgttgtttatgttgtgataagtctatatatttagaaaatgatgttatagatgaaaaagtgaagaaaattaaatcagttacgaaagcaccatctactatcattaataatttctttgctggtgctatgcttggttcagaacttattaaattctttgcacgcgattacaaatcaatgcaaagtattaattctgtaataggaattcacaataagaattttaagtatgaagaaattaagttagccaaaaattataattgcaaatattgtggagtaaataatgagacactatgaaaaaatcatcactagctgtgtatctacctctgcaacccgtatgctgattggggcggtctccacagtttatatgcttgtatcaggcattaatttatatgaagttgggttaattaaaagcactcaggctattttgatttttgtgctgggatttgcagtcggcattctgtcagaccgaatagaacgaaaatggctacatattaccgccttaattttttcgactttttggctctattttttctaccttgcgggtttatacaagagctttaacctctttttattagcagaaatcctcaatgcgatttctctctgtatttatcaaaacaataccaatgcttatttagtagatcagttttatcacgagcaaccgaaaggtgaactcagtcttgccttaggaaaattaggaaaatgggagttttccttgatggcattttctgctttattaggagggggcttatactctacgctatcagagaacctctttttattaacaacgattattatgtcgatcgttacagtcgcttcctttattttgcttcccaaggtgagcaggagagctacacataagactctaccatttattcaaaagcaggactttttaattcttatacgtaaattcagtcgctacaaacaagctattttcttatttgtggtgctaagcctctattttcaaattatcattcaatattggcaagcagttgtttacgccataaacaaatcagagcagaatggacttattctaggagggatgctatttttgatgtttatggtacaatcttgggcaggaaaagcaattgaggtaaaatatccattcagtcgcttaacccttgccttaagctttctcagtagtatggtgttatccttttttgcagaacggtggcaatcggtcttcttttacacaatcgccatttgcttagcattatttgtggtacgatatacagtgattcaaaccgacacagagctacatagacatttactctctcgctttagagcaaaatacgatatgctactcaactcattagtgagaattttaaccgctgtagtcttactgatcattggttatataagcaatctttatggtatacaagccattcaaatcattggattaataattgctatcatatttaccctttttgcattaataacttcacaaaatgtaaaatagaaaaaacttaacccattgtttaagatgagaaaatggatgtttttatagtctattttttaatctaaatgaggagtgaatatgaaaaaatattctagcaccagtattgcattattacaacaataagtatattcaagtgaaagtgtgtcctatgaaatacagaacgcagttcttgaattaaattaggttaacttaaaaacggtataaacctatgtaatcagttatcatattaaagatattagctcgttgggtttattccaaaccaatgagctttttcacagtaaatttctttatgttgttttagattcctactataacggggtttacattgaatagatatccatcaaaattagtgtcctctacatcggataattcaagcaatttagttttaacattttctagatgttgccacattgctttacgtgccaaagcaggatttttgcgctgaatcgcatttaaaatcgtttcatgatctttaatccataagtgatggagatcattatgtatgatacgcgaatgaagctgtgtccacatagcattattaaaacgatatttccaaagttgctcttgagtttgaataaggacatcgtttccagtaatttcggcaagagcaagatggaattctttgtcagcactgcagtcatcaatattttgagcaaataattccttttctttatcaagaatttgcctaagtcgtaaaatatcttgtttggtaacctgttgtgcagcaaattcagcaatactgctttctaacaattgtcgtgcttgaagtagttcaaatggacctacatcttttagcttattatccgcttcttcttgaagaagatctgggatttttatgacgtatattccggatccttttcttacttcaataatcttttccacttccaacattactatcgcttcccttacgatagttctacttacttcaaatctttcagaaatatttctctcggtaggtagcttatcgcctattttgtattttccttgagaaatttcctctttaagtatttttcctatttttgtgtaagttctagaattattttgcataaatcctcgcaatattggcacgccaaaataaatttatgtgatcagtatcacaattatagaaaattggaataccaaaaaatatactttgatgttactgtctgttcataaaatatcattgacgacattaaatgtcgattaactttgttaaagagggaaacattatgagcaaatacgtaagatcagtttgtctcgtggaacctaagaaggttgatataaagaccgtgttgtatcctaaaaaaggtgagtgtgatgttctgatcaaagtagagagtataggaatctgcggatctgatattggtgcatttagaggtactaatccgctggtaacttaccctagaattttaggacatgaaattgttggtacagtcattgaagctggtgttggtatgccaaaaaatattaatataggtgatcgtgtcattctcgaaccttacatttattgtggacattgctatccttgttcaatcagtagaacaaattgctgtgaggcactaaaagttttgggggtacatattgatggagcaatgcaagaaattgttagacatccagctcatatgcttattaaagcacctgatataccgatacatgaactggctttagcagaacctttaactatttcattacatgcaattcgtagaaccaaagtaaaagccggtgaacacgttgctatcatcggtgctggtgcgattggactgatggccgcattagttgccaaagcttatggtgcgacaccaattttaattgacattttagacaagcgattagattacgcaaaatctattggcattccaaatataattaacccagcaaaagaaaatgatcttgaagctattaaatccattactaacggaagaatggctgaggttgttattgaagcgtcaggagcaaatattgctgtacaaaatacgcttaaatatacttcttttgcaggacgtattgctttaactggatggccgaaaaacgaaacgccactaccaactaatttaattaccttcaaagaacttaacatttatggagcaagaacaagcaagggggaatttgaagaagcattaaaacttttagaatccagaaagattgaaccgaagaatattattagtaaggtaattacatttgatgaaattcctcactacatcgaagagctttcagaaaatcctgatgattatttaaaaatcattgctgtattttaagtcttaactaacctatgaggtaataattatgaaactcaaaaaattaactaaagtattagttgttgcaggcttagtatttagtagttcggcatttgctaaaactgtaattaaaatcggacattttaattccgatatgcacccgtcaaatattgtattaaacgaagttttcaagaaaaccgttgaagaaaaaacgcaaggtcgctatgaaattcgtattttcccaaataatcaattgggcggcgaagatcaaatcgtaaatggcttacgcaatggtacgattgaaggtggaattaccggcttattattacaaaatgtggatcctatttttggtgtgtgggaaatgccgtatttatttaaagacaatgttgaagcgaaaaaggtattggaatctccgattgcaaaagaaattggcgataaaatggaacaatacggtattaaattattagcttacggcatgaacggttttcgtgtgatttcgtccaataaaaaattggaaaaattcgatgatttcaaaggattacgtttaagagtgccattgaattccttgtttgtggattgggcaaaagcaatgaatattaacccgcaaagcatgcctttaagtgaagtctttactgcattagagcaaaaagtgattgatggtcaagaaaatccatatatgttgctcaaagattccggtttgtatgaagtacaaaaatacattatccaaactaaccatattttctcaccgggattattgcaattaagcttgaaaacttggaataaaatgtcaaaagaagatcaagaaattttcttagaagcggctaaattatatcaagagaaagaatgggaattagcgatgaagatggaacaagatgttaaagacttcttccataaaaacggtaaagaagtaattattccgtccgagcagtttaaagcagatatgttgaaagcctctgaaacactttatcaaaatttttatcaaaaatatgattgggcaaaaggcgtgattgaaaaaattcaagccgctaaataattgaaatcataggctgtttgttagcaaacagcctttttcctatcgctttttaggagataaaacaatgaaattttctaccgcacttgaccgcactttaaagatgttggcagtgattgcattagtgacaatgattttattggtcttttttaatgccatgctacgttattttttcgattcaggtattgcttggtcggaagaatttgctcgaatttgtttcgtctatatgatttttttaggcattatcttagttgccaaagaaagagggcatttgactgttgatattgtgatttcttatttacctgcatacgtacagatgtatgccttattttttgctgatatattagtgttgcttgccttatcttttattacttatggtgcatatcaattaatgttgctgacttatacacaaaaaatgcccgcaacggaaatttctaccgcatttttatatttagcagctgtgatttcttccttatcttattttctcgtggtttttaccaatttatggaaacatttaaaactggcatttagaggagggaaagcatgatgttaggattatttttaggtagtttattcctatttttatttcttggtgtgccagtagcgttatcaatgttactgagtgccagttttatgttatggcatatggatatgtttgatactcaattaattgctgaaaactttgtaatgggtactaataactttcccttaatggcaattccattttttatgctgactggtgaaattatgaaatacggcggtatttctgagcggattatcaattttgctatgagtatggtaggacatattaaaggaggattaggttatgtagtgattatttcaggtttaatctttgctgggttatctggttctgctgtagcagacaccgcagcgttaggtgcaattttaattccaatgatggtagctaaaaaatatgatgttgctcgttctacaggtttagtttgtgcggcaggaattatttcggtggtcattcctccaagtattccaatgattgtatatggaattaccgcaggtgcatccattaccaaattatttatgggtggcacggttcctggattattaatggttacaggattgtggttaatgtggaaatttttatatcgtaatcacgaagaaaatataaaaccgaaacaatctggtgcagaacgctggcaagcttttaaaaaagcttttttcccattattgttaccggtcattatcattgttgggttgcgtggcggtatttttactccaacagaagcaggtgtagttgcggcgatttatgcgggattggttagtcttggctatcgcagtttaaataaagaaaatttaatcgaagtctttttaaatacgattaaaactacttcaatggtgatgtttgttgcggctgcggcaatgatttctgcatttgcaattactgttgctcaaattccaacggagttggtgcaatttatcaaaggattaactgacaattcaacggtattaatgttggttattatgattttcttattactcgttggttgtgtaatggatttaattcctgcagtattaatttttgtacccgtattattgccagtattgagagcttacaatatcgatattgcttattttggcattatgatggtgattaacttatcgattggcttaatcacacctccagtgggaacggtactttatgttggttcgggaattgctaaacttggcataagtaaaattagtaagggaatttcgccgtttttgttagtttatgttgctattttaatgttgatggtgttctttcctgatgttgtgattgtgccaatgaattggttatcttagtggtgcttattatatccattgttataaagacaaagttgtcgtaatgacagaagctggcaacatgaataaagcgatattttgtaataaaaataacgtatagatcgcaatttttacaaattgatttgacagaaaagatattcgggtgtaaaacattttttacatttcattaacattttggaacgttttatgctcaccattcatcatacgagtgaacaatcacttctctgtgaaattgctcctcctgctgaacttgccaagcaacagcgaatttggcaaattgcagagcaggctaggcaacttgccaatgtgcaagaagtagtggttggtatgaataattttactgtctattacgatttatttgcagatagtcaaccattaattgaaagcctgcaatcactgtgggaaaattatcaaccacaatcagttaaaacaccacgctgtattgagattccagtgcattatggtggcgagtttggtgaagatttatttgatgtagcacaatttcaccaaactacgccaaaagaaattattcgccgtcataccgaacctgtttacactgtgtttatgatcggttttcaagctggatttccttatctaaacgggttacctgaaaatctttatacaccaagacgtgatatacctcgtactaaggtgcctgcaggctccgtcggcattggcggtagtcaaacaggaatttatccttttacctcaccgggtggctggcagttgctcgggcgtactgatttagcactatttgatattcaacaatctccaccaacactattaagtgcgggtgataatgtccgttttgttgcagagagtattcaactatgatctacattaaacaagtgcaaggttttgctcatattcaagatttaggtcgttatggctttcgttctctcggtattggacacagcggtgcaatggattctttggctttacaagcaggcaatttgttactaaaaaatgcaaataacgccccagcaatagaaattacgcttggtggaatgagtttgacatttgattgtgatactccattttgctttactggtgcattagtagaggctgaactggatggcatgcctgtattttcctactttcgttatactgccaaagtacgtcaaactttaacgcttaaacgtattataaaaggtaattatacttatctttgcgttgccggcggttttcttgtaccacaggtgcaaggctcagccagtactgatcttagagcgcaatttggggggtatcaggggcgtatgttaagagcgggggactgtattcccaccgttttgcgtgatatacagttatcatttctcagcattgaaccaattgattttactcataagattgggacgacactttcgtctgaatatgaggcatttactactgaaagtcgtgagcgtttcttccaacagagatgggttctacaaaataacagcagtagaatgggctaccgttttgcagaaaattcgttaaaactgaccgcacctcttgaaatgctttcctatgcggcacctgctggcacagtgcaagtgccacctgatgggcaacctattgtactaatggcagatgcacaaactacaggaggttaccctaaaattgcttgcgtgattagtgctgatcttggaagacttgctcagacatcgattggcagtgcggtgcagtttgaattattaagccgaaaacaggcggtggcacgttttaaacaagatcagaactatttagaggatattcggagaaaggtaaatgaaacagattgatttaaatgtagatcttgctgagggctgtgccaacgaccagcaacttttacagcttgtcagttcagcaaatgtttgctgtggattacatgcgggtgattacaacgaaatacgcaaagcgattttgtgggcaaaagaaaacgatgtacgaattggagcacaccctagttttcctgatcgtgaaaattttggtagaaccaatatgcaattgccagatgatgagcttaaggcttgtttattttatcaacttggggcagtcaaagcattatgtgatgcgtccggtgtgacgatggaatatgtaaagcctcacggagcattatacaatatggcagcgaaagatcctcatttagctgcacttattgcagaaacagtgaaaagtgttgatccttcgcttaagttaatggggctttctggcagtatcatgctgactgttgctgaacagcacggtctagcgactatctctgaggtctttgctgatcgacattaccttgctgatggttcacttgtgcctcgtactcgtgatgatgcaatggttgagaacgatgaggaggctatttctcaagtgttacaaatggtgcttgaaggtactgttccaactgttgatggcggtaatgtggcaatcaaagccgacagcatctgtttacatggtgatggtgaacatgcagtcgtatttgcaacgcgtattcgcagagagttaaaggagaaagggattttggttacaagttcaatttagtaagaattttactaaaaataggaatagatgttatttgttctagtcgcctttcttttggttgtttttcttttacaaagcaaagaaaaatagccttgatttctaaaacaaaacataaggaaaacacaatgtcaaacaataaccgcagtgcccttattggagcggcatttttaatggcgacttcagccattggaccgggtttcttaacccaaacagcgacatttacccaaaacttatttgccagttttgggtttgtgattttgctctctattttgcttgatatcggggctcaattaaatatttggcgaattattgccgtttccgaaaagaaagcccaagatgttgctaatgcagtattgccgggtgcggggtattttctcgcattgcttattgtgatgggtggtttagcgtttaatattggtaatgtgggtggtgcaggcttaggtttgaatattcttactggagtatctcctgaaaagggagcaattatcagcggtattattgctgttggtgtattcctatttcgtgaagctggtaaagtaatggatagatttgctcaaattatggggtttgtgatgatcgccttgactgtctttgtggcagtaaaagccaacccacctatcgctgatgccgttgttcacactttcttacctgaaaaattagatgttattgcgattgtcacccttgtgggaggtacagttggtggctacattacttttgccggagctcaccgtttattagatgcgggcattaaaggaaaagaaaacttaaaagaagtgagcagaagttctgtttctgcaatcttaattgcttccattatgcgtgtggtgctgttccttgcggtattgggtgttgtttcaatgggtgtccaactggatccaaaaaacccagcctcaacaccatttgcttacgttgccggtaatgtcgggttaatgattttcggtatcgtaatttgggctgcatctattacctctgtgattggtgcggcgtatacctctgtatctttcattacctcattttcaccattcatcgaaaaacacaaaaattgctttatcgtggcatttatcgtgatttctaccgttgtgcttgctaccataggcagaccagcccaagtgctagtgttcgtaggaacattaaatggtttaattttacccatctcactcggtttagtcttattagcagcttataaaacaaatattgttggtaactataaacaccctatttggatgacaattgcagggactattgttgtcgtaagcatggcaattttaagtattataactctctcaaaatatgttttggggctgtttacttaattgatttaaggcgatgatagcaattttcggtttctctttacttggaagagaaacctttttccattatgatcttgtctaaatttaacgttgctgtgtaaacatatattgcaaatgtataaaaatctatccttacttttacttgatgatttgttcgatttagaattagttgcgggtcttactcaatgtgagaaaggtaattaccttgattctatggtagatagacaacaaggaatgagtggctatatgttacaattaactacttttggcacaggcattatttttgatggtaaacattctttttccactcatcgaggacaattgttactattcacaccaagtgcggttcaacattatcacagacatccagaaagtcagtattggcactataaatggatctattttttaccaaacccaaaatggaataaatggttaaattggtcaaatatggaggaaaaaatagggcgtattaccattagtgatgaccgctactttcaggaaatcagtcagcttttcagcaaaattgaagtcgaattgaaatcaagtaaattttttaaagaagatgtagccaccagtctattagaatacttacttatgaaaagtatttctgccgagaaaattgaagttattccagtaattgatcagcgtattttaaatgtttgtgatttaattttgaccaatttggctaaaaatgacagcttagaagcactagcaaaaaaagtatttttatcgccatcaagattatctcacctttttaaacaatctttgggtattggcttagtgcaatggagagaagtacagcgtatttccgaagctaaaaaattactttatttctctaacatttctatctcaaatattgctaaatctttaggctatgaagattctctctacttttcgaaaattttcaaaaaacacaccgcactgtctccgtctaaatttagaactttagaaagatgtaaaaacaatgaaatgtgatccagatctcactttactttgtatagcagaattttccatattgataaaaaaaagttacctatttttccctcacacaaaagcataagataaaaatggctttaatagtatggtttctattagagaggtaatatcaagctttttatacgatattcaattaaaggacttcttattttatgagggaagaataatgaaaaaactcactttaaaacatacattattttcaggtattttagcactgacttgttatggttcagttcttgctaatgacgtagttaatatttctaaaattgacggtatgccatggtttaatcgtatggcagaaggtgttgtacaagcaggtaaagataacaatattaatgcttatcaagttggaccatcaaatacagatgctccacagcaagtgaaattaattgaggatttaattgcaaagaaagtcagtgctatttcaattgtacctaatgatgcaaatgccttagaaccagtgctgaaaaaagccaagcaaaatggtattgttgttttgacgaatgaatctgtaggtcagccaagtgcagattgggatattgaaattattgataatgcccagtttgctgccgattatgttgaagaagtcgctaaagcaatgggcggtaaaggcggatatgttatttatgtcggtggtttaaccgtacctcaacataatttatgggcagatctatttgtaaaataccagaaagaacattatccagatatgtttgaagtaaccagtagaatgcctgttgcagaaaatatcaatgatgctcgccgtaccacaattgatttagtcaaagctcactctgacttaaaagcagtagtctctttcggttcacaaggtcctatcggtgccggtttagccgttaaagaaaaacgcttgaaaaataaattaaatgttttcgggatgatgattccttctcaagctgcaaatttaattaagagtggtgatattacgatgggtattacctacgatccagcaagtgcgggttatgctcttgctgcagttgctgccaaagtgttgaaaggtgaaaaaatcgaagatggtttagaactccctaatgtcggtaaagccaaagtggatacagagaaaaaactcctccaattccataatgtacttaaagtaaccaaagataatatcgacaacttatattaatctatattgaatatgggttctttctgaacccatatttctctcaggaggctttatggcatttattttgatgcaaaatatcaataagacattccacggtgtaaaagccttaaatcaagttaatctctctttagattatggagaagctctctgccttgccggacaaaatggttgtggaaaatccacgctaatcaaaatcctctcaggtgtttatcaaccggataaaggggctgaaattcaaattggtgcgagcaaatataccaaactgacgccacaagcttctattgaacagggaattcaagtaatctatcaagatttagccctttttcctaatttaactgtcgctgaaaatattgcaataaatttacatcgaaaattaggttgggtcagccaatcagaaatttatcaagttgcattaaacgcaatacaaagcattaatgcagatttagatctcaatgctattttagaagatttaccaattgcacagcaacaattagtcgctatttgtagagctcttgcacaaaatgcccgactgttaattatggatgagccaacagcatctcttacagcgaaagaagtacaagatctgctaaaagttgtactcaagttaaaaagtaaaggcattagtattatttttgtcagtcataaattacaagaagtaatgagtgtctctgataccgttttagtacttaaaaatgggaatatggttggacaataccctattagtgaaatggatgaaaaacgcttaggattcttaatgacaggcttggaaattgactataaacggttagatttgcccgatttttcgcaaaatagaaccgttttagaagttcaaaatttaactctgcctaaccagtatgaatccattaatttctcattaagagaaggagaaattattgccttgaccggtttactcggctcaggtcggacggaactgtgccttagcttatttggaatcactcaacctaaatcaggtgatatactattaaatggtgagaaggttatatttcaaaacaaccgtgatgctattaaacaaggaattgcttatgtttctgaagatagaatgacaactggtttaattatgactgaatccatacatcataatattatctctactatttttcataaaatcaccgataaatttaacattataaaatcatcaaaagcctataattatagccaggaattaattgaatctttaaaaattaaagtaacggattcagatttgccagtaaatacactttccggtgggaatgcccagcgggtgtctatcgcaaaatggttagcaatagatcctagaattattattttagatgctccaaccattggggtagatattgcgaataaggaaggaatattccaaattattcgcacattagcacaaaaaggtatcgctgttatttttgtgaccgatgaggtagaagaagcatactacaacagtcacaaagtcatagtaatgaaaaaaggtaaaattgtaggtgagatattacctatctataccacagaaaaatcaattgcggaggttgtttatgaaaatcaccaataatcatattttatctacgacaattttgatactggcaaccttattaagtctattcacgaatgacttcgctaccattgagaatatctatgatgtagtcaataactattcaatgctaatgattttagcttgtgggttgtttgtggtgttactatcaggtggcattgacatctcatttcctgctatcaccattatttcacaatacattatggtaacggctataggcaaatatgatatcggttttttcggcgtatttgcagtatcatccgcaataggtatcttacttggttttattaatgctctttttgtaaaccgccttagtgtaccttcaattattatcaccatctcaacattaaatattttctacggaggactactctattttaccaagggtgtttggttatacgattaccctgaatggttcacccaagaattgctatttttcaaacaaacctcgcaagatggttttgaattcggtttatcttttcaagcgataatggcgattttatctatattattaacttggttgatcactagcaggttaacaataggaagaaaaatttatgcccttggtggaaaccaagatgccacctctcgtattggttttaatattttattccttcacctatttgcttacggctatatgggatttatggctggaatggcaggtgttgtgcaatcttatacagtgcagtctgtcgcccctgactctctacttggttacgaattaattgtactagcagccgttgttttagggggggcaagtttatctggaggaaaagggacattatttggcactgtaatgggagtaatgttactagcaattattcaaaatgggctgaaccttatgaatgtatcctcgtattggcaaacgataattaccggtatcattatcatcttaagtattagtgctactgcattagggcaattgaaaaaacaaggagtataacgatgagaagcaaatttgatcatactattttttatctgttggctctttttattattactgttattgcctttagtattttaattccagatattttttggtctgtgagtaactttcaatcaatggcatcgcaaattccagtcttaggaattttaactcttgcaatggcattacctatgcttacgggaggaataaatctttctattattgccagtatgaatgcttgctcattaattattgcttgttttattacgaagcatgctgggatttcttggctatttctatctattgtattaagctttttatgtgcattaattattggggtgatcaatggtgcactgattgctattatccgagtttcaccgattctagccacgttaggcacaatgacattaattaatggcataaatatattagtaacaaatggttcaacggttgctggctttccagaaataatactgagtattaatacctcaacttttttatggttgccactgcctattctgatttttttattccttgctggacttgtttggtttttcttagaaaaaacttctatgggtaaagcggtttattttatcggtaataatgaaaaagccacatattactctggcattaataccaagaaagttctaatttggatatatattatctcctctgtactctgtgtattcgtagcccttttaatgatgtctaaactcaactcagccaaagcatcgtatggagattcttacttgctcatttccattttagcggcagtactaggtggatttaatcctgatggcggcaaaggaaaacttatcggcattatgttagctcttgtattactacaggttattgaaagtggattaaatatgttaggtatcagtagttatattacgatgattttatggggtagcttattactactgtttatattcttacaaaaaaatcgtcttttcctattaaaaaactaagggatgtacgttatgcaaaatgaaaaacagcttattgaacaaggtaatatcgttattggtattgaattaggttcaacccgaattaaggcagtattaattacctcagatggtactattttagcaacgggtggagcagattgggaaaataggttaattgaaggagtttggacataccatcagcatgagatatgggaaaaactacaagcggcgtatgtagatttgagtaagactgtaaaagcaaaatatcacaccacaattcgtactgcaaaagcactgggaattagtgcaatgatgcacggttatttgccttttgataaacagggaaatcagctggtgtcttttagaacatggcgaaacaatataactttaaaatcatcggaaaaattaaccgcactttttcaatatccaattcctcaacgttggagtattgcccatttataccaagcattactcaataaagaaccgcatttatctgaaattgattatattacaactctctcaggttatgtgcattggcaactaactgagaacaaagttttaggaattggagacgcttctggtatgttcccgatagatactgagatgcaatcatacaataaaactatgctgactcaatttgagcaggctattattgaatatcagatgccttggagattagatgccattttgccaaaagtattagtagctggagaacatgcgggtaaattaacttttaaaggggctaaattacttgatccaacaggtaacttacaggctggtattccactttgcccgccagagggtgatgcaggcacaggaatgattgcaaccaattgtatcaaagaaaaaacaggtaatatatctgctggtacatcagcgtttgctatgattgttttggaaaaagctttatcgaaagtctattcagaactggatattgtaactactccggcaggtaaactagtcgcaatggcacatgcaaataactgtacttccgatattaatgcttggataaatttattcggtgaatgtttagctacttttggtgtttatgtgtgtatggaagagctatatgaaatgctttttctgcatgctttgcaaggtgagccggattgtggtggattactatcttacggtttttattctggcgaacataatgttggtttatcggaaggttgtcccgtttttttgcatccaaccaaagctcgttttaatttggctaactttatgcgtacgcatttttatactgcttttggtgcaatgaaattaggaatggatattttgattaatcaagagaaagtggaaatttctcgtattctggggcacggaggtatttttaaaactgaaggggtcgctcaaaaaatattgtcttctgcacttaatattcctttagcaactgcaagcacagcttcaaatggaggagcttggggtattgcactactggcgaattttcttaccatttctaaaagatataatttagaagaatatttagataattgtattttcaacacaactaaacttaatcttattcaaccggataaaataatgagtgaaggctatgaacgatttatgcaacgttataaacaaggtatttcaattgtggaaagtgcactttttttgaatcagtaaagttacaagcacatagaaaaagcttatgttgtgacgggctgaatcggttgtagaacatctgcccataattggttaataatgttacttaactgttagggcagattgatttttacctgtatgattatgcaaaatattgtgctagatcgtcacttccgccaatatattgcccaccgataaacacttgtggcacacttgttttacctgtgattgcacgaacagaaattgtactcgcatcacgacccagtatgatttcttcaaaggtatagcccttttcttttagcaatgtttttgcttttgcacagaatggacagccgggttttgtgatgatggaaactgaaggtttttctgtccaatttgggtttaagtatttaatcattgtgtctgcatcagagactttaaatggatcgccaggttcttgtggttcaataaacattttttcgactacgccattttttaccagcatagaataacgccaagagcgtttaccgaaaccaagttctgttttatcaacaagcatgcccataccgcttgtgaattcaccattaccatcgggaattactgttacattctcgctttcttgatcagctttccaagcattcataacgaacgtatcgttaactgatacacaaataatatcatcaacacctaacgctttaaattcacatgcaagttcgttataacgaggtaaatgtgttgctgaacaagttggagtgaacgcacccggtaaagaaaataatacaaccgttttattgtcaaacaaatcggcagttgtaacatcaacccattgatctccttggcgtgtacggaatgttacttgaggaactttttttccttccatagtcataattttttctcctatataaagattagttgataaaaaatatgattttaagtttaaactatgttatagtcaaaaacaatcaaaaaaagttatttaattgttaatttctatgataggtgtacagaatgaatattcgagatttagaatatctagtttctttagctgaacataaacattttcgtcgtgctgccgatgcttgttatgttagtcaacctactttaagtgggcaaatcagaaaattagaagatgagttgggtatcgtattactagagagaacaagccgaaaagttttatttactcaatctgggttgcttttagtcaaacaagctaaaactgttttacgagaaataaagctattgaaagaaatggcaagtaatcaaggtaaagaaatgaatggaccactacatatgggtgtcattccaactattggaccctatttattaccctatattgttccggcactaaaaaatacttttcctgacctagagctatttttgtatgaagctcaaacgcaaaagcttttagaacaattggaaacaggtcacttagattgtgtcatattggcatcagttgatgaggctgaagcctttattgaagtaccgatgtttaatgagagaatgctactggcagtttcagacgaacaccctttatcaaaagaagattcgataaaaatggataagctgaaaggatatgaaatgcttatgctggatgatgggcattgtttacgaaatcaagccttggattactgttttgctgctggggcaaaagaaaatcagaattttcgtgccacaagtttagagacattacgtaatatggtatctgccaatacaggtattactctcattcctgaactggcactcttaaacgaaggttcgagaaaaggaataaaatatctgccatgtttctctcctgagccatctagaggtatttctcttgtttatcgtccaggctctcctctaagagggcgatatgagcgaatagccaataaagttagtgaaataataaaaccgttactaaacaatagaaaaaacggtaattgatatatagcagctatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatttgtttttaggctattttttcaataaatcacgaatttctgttagcaatttttcttcgtttgaaggtgtaattaccttttctacttttggttcttctttcttcaatttatttaatgctttgatcattaagaaaattgcaaatgcaataatgataaaatcaaatatattttggataaacataccatattttaacgtcatagccggagttttatcggttgcttcttttaaaacaatatgtaagtctttaaaatctacgctactggtgaaaaaacttaatatcggcatgatgacatctgctactaatgagctgacaatcttaccgaatgccccaccgataatcacaccgacagccatatcgataacattgccccgcatggcaaactcacgaaattctttaataaaactcatcacatactcctaaaataaacaaatataagtttgaatagatcgtaaaaactttcagtttgatgtatagaaaattgatattattctctaaataaagaaagcattaggttgaaaaagtttctctatttctgttacatattttttatcacttaaataaacaatgatatgatcgccactttcaatgactacatcttttcttgcgatgatcacagtatcttgtcgcaaaatcgcaccaataattgcaccattgggtaattttaactctctaagtttacgtccaattacttgtgatgttgtttcatcgccatgcacaataatttccaatgcttcagcaatgccatgacgcaaagagatcgcatttgcaatatctcctttacgtacatgccccagtaaagcggagatggtagcttgttgtggagaaactgcaatatcaattgttccgccttgaactaaattgatgtacgccatacgctgtattaacaccattgcttttttagctccaagatgcttagccaagaatgccgacataatatttgtttcatcatcactggttaaacataagaaagcgtcaatgttttcaatatgttcttcaaacaataacgatttatcggaaggatctccatgcaatactaaggttttagataatttttccgcaagtgatgttgcacgctctgcattacgttcaataagtttgactgtgcagtgattttccagtttttttgcaacacccacggcgatattacctcccccaataatcatcactcgtttataaggtttttccaagcgttgcagttctgacatgaccgctttaatataaattgttgcacaaataaaagttacctcatcgccggcttcaataattgtcgaaccctgcggacgaatcactttatcttgacgcaaaatagataaaatacggcaatcaatatgcggcatatggtcttttagggcggaaagagaatagccaaccaaagggccaccataataggcttttactacaacaatactaatattttcattagctaaatgagctacttgtaatgcaccggggtaatcaattaagcgagagatttcttcagtaacaagttgttccggtgaaatgatatgatcaatagggatcatgtgcggttgaaataatttatctttttcacgccaatattctgcatcacgaatacgtgcaatttttgtcggagtgttaaataaggtataagctatttggcaagaaatcatattcgtttcatctgaacttgtaacagctactaataaatctgcgtcaggtgctcctgcttctcgtaaaattctcggtgatgatgcagagccgttaatcacttttaaatcatgtttatcttgtaaatgtgccaaacgaacagcgtcattatcaattaacgttatatcattgtcttcactcactaaattttcagcaagtgttgttcctacctgaccggcacccagaataataattctcatcaattccctcttttaatttatacagattgaatacctttatttttcatatttcaacttcacattaatttctgataagttttatgattaattgggcagttttcttaatttggcataataaaaaccgtcacctccctgttctgttggaacaaattgatgaccaatttcctccccaatggtaaaaggcaaaggttctaattttgcatcattgtgcttggctaagaaatgctgaatttgttgactattctcttcaggtaataaagaacaggtcgcataaactaaaataccttgtggttttaattttttccaaagggcttctaaaatttgtccttgcaattgcactaggggagtaatatcactttcttggcgtagccattttatatcagggtgtcgacgaataacaccggtagcggaacaaggagcatctaataaaattcggtcaaattgtaccgcactttcagatttaaaggtcagtcctatagcattaaaatcaatctctgataaccattgctccggctgggttgcatcaccacaaattattatagcttgttgtttcatacgaactaaattttctttcacacgttgtagacgagcaggttcaatatctaaagcgatgacttttgcgttgggtgcttgttctaaaatatgtgtagtctttccgcccggtgccgcacaagcgtctaaaataagttcgtcattttccggttcgagtaataaggctgaccattgtgcgtgtagatcctgaacgctcacccatccttgttcaaaatagggtaataaattgaccgcacttgcgtgatgtaggcgtaatgcttgtgggtgattcgttgttgatgtagatattcctcgctccattaaaagttgttgataatccgcaatagaacaatgttgtaaattaatgcgtagccacatcggaggtttttggttattcgcttcaacaatttcacgccaattggcataagattgttttagtttattcactaaccattccggatgtaaggtttgccaatgcttatccactatcgccagaatttgttcttgttcccgcaaaaagcgacgcaaaacagcatttaacaggccacggaaactatctgattttaaacttttcgtggcagaaacgacttcgtccactgcagcatgagcaggaattcgggtatataaaatttggtataaaccgaccaacaacaagcagtgcacgatccgagttttacctttcaaaggcttatccagtaggagttgaatgatgcgttctaatcgaggtaacacacgacaaataccaaaacaaatttcttgtagtagcggaaaatcttgcggtttgaccgcactttgttgctcaggcagcaaggtagaaagagatttaccttgaactaaaacttgtaaaattacttctgccgcaagcacacggactgagcgaggcgtgaaaagtgcggtagatttgaccgctcttttagttttgttgtgctgagatttgctcataggacttgtcctatcttaaaccaatccgcacggctgtttaataaatctcgtgctgacatcggttttttacctgcaggttgtaattgctccaagtttaatacaccatttgctgtcgctacttgaatacctcgtttatctgctgcaagaatggtgccacaaggcttatcttgatgaggtaacactgaggcttgataaacttttaacgtttgtagcgtgccttgactgtcttgtgttacaaaataactcattggccatggattaaacgcacgaatacaacgttctaattgttcagcggataaagaccaatccagtttagcctcttctttagaaagtttttctgcataattactcagactttcatcttgtacttccggtttaaatagaccttgttctaaaccgtccaaaacctcaagtaaggcttttggtgcaatgttagccaatttagtgtaaagggaggttgaggtttctgtcggtgtaatatcacaacagactttatgtaacatatcgcccgtatccagcccctcattcatttgcataatggttacccctgtttttttatctcctgcccaaattgcacgttgaataggtgctgcaccacgccaacgaggtaaaagcgaaccgtgtacattgagacaacctaaaggaaatgtttgtaacacagccaaaggtaaaattaacccataagcaacaactaccatcacgtcggcattcaatttactcagattttcttgcacctcaactttacgtaaggatttaggttgataaacgggaatatgatgtttttcggctaaaattttaaccgcacttgcccgcaatgtttgccctctccctgcaggtttatcgggctgcgtgtaaacagcaaggacattatgttgagattggagtaacgcttgtaaatgttgtgcggcaaaatctggtgtaccggcaaaaataatatttaatggtttcataagataagctaatgttctacgttatgtaattgataaaaataaaaggcggacaatccgtccacctattgtttaatttaacgattttttgcgatttgtttttgcaatttgagtagtttttctttcatgcgttggcgttttaatggcgacaaatgatcagcaaaaacaataccatttaaatgatctatctcgtgttgaatacaaatggccaacaaaccatctgcatctagcataaactcttctccctgacgattttgtgcttttacttttacagtctctttacgaggcacaaaaccacgtaaaccaggtaatgataggcaaccttcttcaatacctgtttcaccgaaactttcaagaatcttagggttaatcaacacaatttgattttctttagttccttcaatatcgatcgtgataatacgcttatgtacatttacttgtgtcgcggctaaaccaatcccttcttcgtgatacatcgtttcaaacatattatcaataaaggtttgtaattcttcgtcaaaaacgcttacaggttctgcgaccgtttttaagcgttcatcgggataaattaatacattcaataatgccataagttcctttcatattttatgttataaattcaaattgaattcattttactcgtttttataggcttttttaagaaataaaataaggaaatgggaaaatatctcaactgagatgtgtaaaaaacttcagcgagagcgatttaccggcaaaagagcggtaatttctaccgctcttttttgggagttgtgttatacgcctttatgctggaagtacaaaactgttgcggcaacccgagaatgaacgtttaatttacgtaataaattgcgaatatgtacttttaccgtttcctctgaaataaataattgtcctgcaatttgtttatttgctaatcctgtcgcaatgagtgccagtacattcatttcccgatctgtgagggaataaataggatcatctttatgttgacgttctaacagtaaatttttgatcgattcactgagaatgacttcgccttgtgtaactcgttttatctgagagagtagggtatccggttccgtatcctttaataaataaccgtcagctcctgcatcgattaatgtgaaaatatcatttttcgcatcagaaacggtaagtattagaattcttgcatcaattccttctgtgcgtaaagcctttaatgtatccagtccggataatcctttcatatttagatctaaaatgatcaaatcaggttctaactgcaatgccagatttacaccttcacttccacttccggcgtcacctatgacttcaaaagattcatccagctcaagcaattgtttaatacctcgtcgcatcaaaggatgatcgtctattaagagcacttttgttttatcagacattgattttgtcctcatcatgagagtgcaaggcggctatgaaaaggcacgatttttgttccaccgttgcagtctggtaataattgataaaattgcggatagttaaaattatgctgcacgattttatatgggttgttgtttttatccaagctcgccgattgataaatttgatttatctcacgaattttctgttcttttgagccttcacaatgtcgatagatttcaatgtggttttgttcgtctaaaatatagacattaaaacttttatcttcattatcttcaaagaaaaattgtaagaaaccttcgcttgcaaaagcatccatttcataaggataatgtttctgttctgctaaaagtgcggtttctttttcctcaatagtattacgtagttcattatcaaatacactattatttatcgaagtgttttgcatttcctgtaagctgagtccacgctcttcaaagaataattgccagtttttacccgctattctcaacatattatttttgggggcatcggtatcaccaattcgtatatcaatatattttttgataagtgcatggacaatattgcataaggttttttggtagtgttggctgtaacaaaagacgttaattgattttggcggtgttgagccgggataaattttgtttgataacacttttaatgctaatagaatggcattggcaccctcaaaatgcaacgtgcggatctcattccagatatttctataagtgaggtcaatacttcctacgagactttcttctgaaggcccaaaactgaataagtcacttggtaaaatagtcgacttactttgcaacaaatgagcagttggatcgttagttaaattgattgtaacggagagatgttttattttgcattgttgagttaattccttatttgttgcttttttagtacgggtaatagggaaagataaacgcaaatcagcaacgaaattacgtagcgttttaagagatacagtatcactatgaatataaagcgaagtgattggtgtaagcaacccattaaaataggcccatgaaactaatttatttagattttcgccatattctatgtggcgtttttgacaaagtccttgtacatccggtttttgtgttactaaataccaaccggctttgaagaatttattttgtttcacttcaatgaatgttaagtgcggttccgataaatcaagagaaatagcttgattgagcaaggtgatttttcccggtaattcttcaaaagcggtgtaaagttttctggtcaagatagaaacatcttgtggcatgatactggcatttacattatgtttacgcccgaagttaattagatttcgatagctcaacataaggtattgcatcaggtcattgtgactttccttaacttttttgattttccaagttgtacgttgatttagattttgaagaagattatctgaccaattccactgctgtgtaagttgatgcagtttttctgaacgccaattattttcttgttgttgaacgatatactcactggctttcatataaaagcaacgtctcacaaaatctaatcttttgaattcattcagttttgttaaaaaagaactcactcgctccaacattgctaagtatgggtcatagtgatagtcaagatcgttattcagcagacgttgtttgaattcttgtgcaattaagtgagtatttggatattcataagaataactttcgagtaataagattttgagtaccgatttatagggggaatcgatacctttatatagttgccatagacttgcaccaaaatattcgttcgctgaaaacgcactcagacaaccaaaatctacccaatcatctatattgatttgctttgttttgatgagtcgattgacttcagaactataatcttgttcatttgctacctttagatgtaaccaaagtagcggtttaccggcaaggcgaataacagaacgatagaactcctccagtaataacatatattgtgcggagccactattttcagaagtaagtgcatcggcataacgaaagctacgaaaacgctgttggtcaattaaataaagattaatttctacgccaagacttcttgcccattgttgcaataagtgatttttttttgaaagttgttctttatcttctaagctaagatcttctcggtggcatacccaaatatctaaatctgagcttggtgtttggctgatagaaccgatacttcccataacgtaaacacctaaaataggcgtgtctgtgagatgttgtaatgccgccaaatgtgtactaagttgctcaaaatcaccctgagggagatgtgtagttaaaaattcctgttggtattttgataattgaaaacgagcaatgccatgtggggcattcggtaggtaaccgcccatcaagggatgatttatgtgtaacaataaggtaagaagttgtaatacacgttggaactctactgaagttgaagatagtgctctttctaaacgtaactgatcaacaaattcaacttgtttcttcgcttgttggagatcgtatttcaagttattctctatctagataaattaatcgttgcttactctatcactccccttgtatgaaagcaaaaaaatcgagtaaaaaattaaatctacactgacatttcagagtaacagtgataggatattgcgattacgagtctaatctatatttctacatatgagtatcaacaagaccctaaaaattgcgacacgtcaaagtccgttagcattatggcaggcaaattacgttaaaaatcgcctacaacaacgttattctcatttaagtgtcgaacttgtccctatcatcacaaaaggcgatgttatcttagatacacctttagctaaaattggcggaaagggattatttgtaaaagaattagaaaatgcgttgttaaatggtgaagcggatattgcggtgcattcgatgaaagatgtgccaatgcaatttccgaaaggattagagctaagtgtgatttgtccgagagaggatcctcgtgatgcatttgtttcaaataagtaccgcactttagacgagttaccgcaaggtgctattgtaggaacatcgagtttacgtaggcaatgtcaactcaaaaactggcgagcggatctcgatatccgttctttacgtggtaatgttggaacaagattaaataagttagatcagggtgattatgatgcgattatcttagcttcggcaggattaattcggttaggattgactgaacgtattcgctcttttattgaaattgatacgattttacctgcttgtggacaaggtgcggtaggaattgagtgtcgggtagatgatcgagatgtgcaatctttattgatgccgttggctgatcagacgaccacttattgcgtattggcagagcgtgcaatgaattttcatttgcaaggtggttgccaagttccgattggtgcttatgcaattttagagaataatcagttatatttgcgtggtttagtgggagatgttcacggttcacaaattctatcggcagaagggcaatttgaattatctcttgattttgaatcatcgcaaagtgcggtgcaaaaagcggaagaattaggcgtgagtattgctgaacaattattacagcaaggtgcagataaaatcttacaggctgtttatcaatcataattgagtaagaggcaatggcagttttaattacacgacccggtgagcgaggagagcgacttgttgagatgcttaataaagccggaattatggcactccatttaccgcttatttccattatagcggggcaggaattaaatcgattacccaataaattacaacaattaaattgcggtgattatgtagttgcagtatctaaaaatgcggtggaatatgcacaaaaaaccttaagtgcggtaggtttttgttggcgttcggacttatattactttacggttgggcaacgaactgcagaatattttgcgagccaaatagaaaattcggtgtattatcctgttgagcaagaaagtagtgaaggattacttaatttacctcaaatgcaagaccttcaggcacggaatattttgattttgagagcgaatggaggacgggaattttttactgagcaggctattttgcgaggagctaaagttgaaactctggaatgttatcaacgaatgcccattgaatataataagttggaaaaaattagtttatgccaacgtattggggtagataccattgttgtaacaagtcaagagatgctaaattacttagtgaaacttgtgccaaccaatgaaacaggctggttattcagttgtcgtttagtaacggtaagtcaacgtatagcggcattggcaaaaagtgttgggtggacaaatattgttgtggcagataaagcggataacttgagtcttttccttgcattgcaacaatgaaggctggaatttcatttgattaaggaataaaaattatgacgaagaaacattcaaaggttagcacagaaaaacaggataatatatccgtgcaaaatcctcctttggaggcagaattgcaatatgaggaagtaccggctgaggatattgtaaagcaagaaagtaaggctaaacaggaaactttttcaaatcaggagcattttatggaaagagagaatgaacaagttggcgaaaaaagaacagcagctcaagttgaaactgtagtggtgaaaaaaggaggggcagtcattgctctattagctttgcttattgcattgggtattgggggagctggctattattttggtcaacaaaaagtagaagaaattcagcaaaagttgaccgcacttagccaaccgtcggaagctgtgccgctagaaaacaatgatactttgttggtaacagttgaagaatataagcaaacttttatacagaagattgagcgactggaaaatgaaatgacaaaacaaaaccagcttattcaaagtttacaagcacaagtaaataaattggatgcggttggtaaagttgaacaatcgacggattggttgttgtttgaaacagattatttgttgaataatgctttacgtaaaatcgtattggataatgatgtggagacagctattgcgttattgaaagtggcggatgaaactctcgttaaggttaatgatcctaaagtcattaacattcgtcaggcaattaatgcagatttaaaacagttattatcagtaaataatgtagatcaaaatgccatcatgcaacatttatctcaattagcaaacggtattgatgaattagttgtattaaatgtgaatttcgatgagcaagaaaatactcaattaagcgattccttacaggattggaaagaaaacgtagaaaaaagtgcggtatcttttttaaatcattttattcgtgtaaaacctcgccatgtgaactcaaaggaattacttgcaccaaatcaagatatttatttacgtgaaaatattcgtttacgtttgcaaattgcgattatggcggtccctcgtcagcaaaatgatttatataaacaatcacttgaaattgtaggttcttggataagaagctattttgatacaagcactgaagtggcacaaaacttcttgaaagagattgatgaacttgctgagaaatctatctatgttgatgttcctaaccaattaaaaagtttgcttttgttggataagttattgaataaggaacagtcatctgtacaaaaaattgaaatgacagtagataaagacttggttagctcaacagatcaagtatctgaggaagggaaaacagatcaagctgttgaaaaatctgatgaaaagccaattgaacagcctgttgagcaagcacagtaataggagaatagcgtatgttcagagttctatttttaatgctggttttattggctggattaattggcggtccctatttatcaggtaaacagggatatgtgttaattcaaacggcaagctataacatcgaaatgtcaatcacgatgttggttattttctttgtgattttaatggccattgtttatctgattgaatgggtggttacacgtttcttccgtttgagtaataatacctatagttggttctctcgtcgtaaacgtgttaaggcacaacgtcaaactttggaaggcttagtgaagatgaatgagggcgattattccaaagctgagaaattgattggaaaaaatgctagacattcagataaaccaatattgaatttaattaaagcggcggaagcggcacaacagcgaggcgatgattttgttgccaatcgctatttaattgaagcaacagaattagcaggtacagacagtttaattgtcgaaattgcacgtactagaattttattgcaacaaaataaacttccggcagctcgtagttcggtggatagtttactggagatgacctctcgtaataaagaagtattaaagctggcagtgaaaatttacctgaaatctgccgccttccacgcattggataaaattctagatcaaattgaaaaagttggattatattcttccgatgaattcaccgcccttcagcgtaaagtcgaagatggtttattagacgagaaaatgaacgaagagggtgttgatgggttattacgttggtgggatgaacagcctcgtaaacgccgtaatgatttatatgttaaggttggtttaattcgtcgtttactggacagtgatgatcatgaaagtgcttatgagttagctattgatgctctgaaaaaagttgaaaatagtgttgaagctaatgttgctctttgtactcaaattactcgtttacaaccggaagataacagtaagttattaaaacttttggaaaaacgtgcaaaacagtcaaacagtaaagattgttgctgtgttgaacgtgcgttaggttacctttatgtgcgtaatgatgatttcgctaaagcggcagaagcattcaagaaagtgatagagaataaagcgagcttacaagcaaatgatattactatggcggcttatgttttcgaacaggttggagagcttgaattagcacaaaaagttcgtgaggaaggattgagaaatgcgatgtcaattaaagagtcggaaaataaaaccaaaaaaacagcagaaaatccgaccgcccttttagaacaaaaatcctaaatatattgttaaaaatgcccttaaaaatcattgttaagggcatttttataggttttatttttcctcaatgaaagttaaggctttttcaataacctccacaccagcatgagatttatggatgttttcactcatatagcgtctccattgccttgcccctttacattgttgaaatgcacctaataaatggcgagcaatatgattaagataaacgccttgactcaattgttgctctatgtaaggaaacatattttctattgcttgtcttggcgtgataattgcacaagacggatcaaataacgcttgatcaatatagcccaataaagacgggttttgataagcttcacgcccaaccattactccgtccacataattgagatgtcgttgaatttcttcaagcgttttaattccgccattaatgctgatcaataaatcaggaaaatcctttttcaactgataaactcgctcataattaagtggcggaatttcacgattttcttttggacttaaccctgatagccatgcttttctagcatgaataataaattcttggcaaccgatattatgtactttttcgataaaatcacatagaaattcatagctatcaaactcatcaataccaagacgtgtttttactgtgactggaatattgaccgcactttgcattgcgttcacacattctgctaccagatcagcccttgccatcaggcaagcaccgaacataccattttgcacccgatcggatggacaacctacattcaagtttatttcttgatagccacgttcttcagctttttttgcacaatattgcagtttttcaggatcacttccgccaagttgtaatgccacggggttttccgatacatcataagcaagatgatcgtatttggcgtgaataattgcaccggtagtaaccatttctgtatagagtaaggtatactggctgaactgccgatggaaaaaacggcagtggcgtgtagtccagtccagcataggagcaacggaaaaacgacctcgataaaagtgcggttgattttgcttcattttttacttgtttgataattgaaacggttagggtttagcgttttcgtgagcttttctctttttgtgcatgccgacggaaacgcccacgcctaaatgataaagtaatacaggattaatttggcgtgaaacaaaagccgttacaatacaatcaatgaatgcttaaatcaagccaatttgatgagttgttattgttggtttaaggattgcgtacttaccactcaatatctgagctaatacggtatgtctaagagggaataatcgggttattgcttagatttaatatgaaaggtaatttcatgaggtgaagaaattccggtagattttagtcacttgactggaaaagtgaagtagcaacgtaaagaaaaattggtacactctttttaagtttacgttgctgtcgttttagatatttatttaatcccaggagctttccaaagcgaaatggttagtcctctgtcaaccaatttcaattgctgctggtatatttcttgccatttttctttatgtatttgatataaattatgatttcttgcatttggttgatgttgtctttcaaattttactaatgttttacctgcttcatgtaatgaagtataaataccagcacctactccagctgcaatggcacatcctagagcagttgcttcttttactacaggtacattaacaaccaatcctgttacatcagctagaatttggctccataatttcccttttgcaccacctccggcaaaaacaatactggtaagattaacgtggctgaattgctggacttgatcaagattacatgaagatacaattgctgcattttcttgtaatgccctaaacaggactgatttgttacatttttcaggatcaatcgaaaggttaataaatgatggggctgcgtgataccaagatttgaaatgcatagcatcagagaatacaggaataacatcatttgaacctacgggtatcttttctgccatttgttccagtaatgtgtaagcatcaacacctaagcgatgagcgacggctttttcttcttcacagaaagcatctctaaaccaacgcatagtaagtcctgtaaagaagctgatagattctgcttgtaccatcggtgcaatgacatgcggattgatgcgtatattcattttaggatctgtcattgcttgtggtaagtttacgacctgttgccagaaagttcctccaataatagcagcttgccccggttctgtaatccctagtccgatacaacctaattgcacatcaccaccaccaacaacaacaggcgtgccgactattaacccagtttgctgtgcagaatgggcggttacttgaccgagtatttcacctgtctcttttactttcggtaaaatagcaggattgagtccagccatctctagtaaagtgtgctcccattttcgggtttttaggttgagaatgccggttgtgccagcatttgaaggttcgacggccagttctccgctaagcataaatcctaaccaatcgttaatcatagagagaaaatggacttgagcataaagattaggttgatgatgtgcaagccaaagtaaacggggtaatgcacttaatgccagtgtttgaccggaggattgataaacttgttgttcaaactgatactggtttagagactttaattgaataacttcttctacagatctggcatccacattaccgcacgcccaaatcgggtttttattggcatcgtataaaacaatgccttcacgcatagagcaagtcgatatagctataatttgtttagcatctatttggctggtagctaaaacttcttgaatacataagcaagcaaggtgccagttattttgtaaatcaaagcccattgagcctgggatatttgggtcggaaatatgtgtccattctttttgtgacgtagcgatttgatttccttcaagatcaaaaataactgcacgaatactacctgtgccggcatctaatgccattaaataacgggataattgcattatgttttcctccgattatctgaggaaaatcgttacactactttagctaaaatagtgcgtgcggttttttcctctgtgactaatgaattgatatgctgtcctaaaagtgcggcaataattgcttcaactttatcttcaccaccggcaacgccaataatagtcggtattcgcttgatactatctaatgaaacgctgattaattcctcgtgaatcggcatatccggttgaatgtttccattttcttgcaagaaatagcctaaaatatcccccacagcacctttttgacgaaattcatctagttgtttttcattgatgatataacctgtttgaagcaaagtggagcgtgttttctgaaccgtagatccgataccaacgatggcaacatcagccatactggctgctaacataatatctcgtacatacccctctttttggaaaagttgtgcagcttcaggtgaagaagctcgtagaggggcgggaataatactgatagcacagctactatcaagttgcccaatactttgcatataaggtccaacaccgccggttaaggtgattaacttaatctggttttgtttaataaaatcattgcagtgctttaccgtgtgcatcacggtgtcaccaaacccaaaagagagaacttgctttgctttgagtaatcccatcaacatttgagaggctccgacacctaagcgggcattgacttcataattctgtaactctggcaacacacgaatatgctgtaaatgaaaccgctgttttaaagcttcttctagttccaagcatcctttataacgagagttgatttgaactttgattaagccgatttgtcgccctttttccagtaagcgtgaaacttttaaacggggcaagcccaatttctcaccaatttcattttgtgtcagattatcgtggtagtagaaccacgcaatgcgtgctaatagctcttcctcgttaaagccagcttcgtagtgattatctaaatttatcatttttttaccctgtttttattattcatctgattttaattttaatcaaatgttctttttctaaagtgtgaattcgatcacattttacatttaatgtgaaaaaaagacataaaattcttaaaaatgtgaagtttatcacaaaaaaatagaattttttgggttatgatttggaacaaatgataattaaaattttcatttgttcaatttgaagggtcaaaaatgaaagagacagaatctaatcctacgcctttactggaagcttgtgatgtaagtaaagctttctctggtgttgaagtactaaaatccattaacttttccctttattctgggcaggtacatactctactgggtggaaacggtgctggcaaatcaaccttgatgaaaattattgccggtattcagttgcaagataccggcacgttaaaaattcatggcaaagtccgaaccaatttaacgccaagcaaggcacatcaattaggtatttaccttgttccgcaagaacctttgttattttctaatttgagtgtcaaagagaatattttattcggtttgccaagaacaatggatttacagtcaaagctcacagcgttgttgacggaactaaactcacatttaaatttggatatgcaggctggtttattagatgttgctgatcagcagttagttgaaattatgcgaggcttaatgcgagatgctcagattctgattttagatgaacctaccgcctcattaacaccagtggaaaccgaaaatttattcggacagataaattccttactcgtcaaaggggtagggattgtttttatttcgcataaattgtctgaagtttggcaaattgctgattgggtgagtgtaatgcgagatggttacattgccttaagcgagccaattgacaagatcaatcacgacgatgttattcaggcgattactcctcgagctaaaaatgcatcattaacagaaagtcagcagttgtggttggatttaccagggcataagagggtgaaatcgaccgaatttccattattgacagtagaaaatttcactggtgaaggattccgagatatcaactttgaaatttatcctggcgagattttaggattagcaggcgtagtcggctcaggtagaaccgaattagctgaaacgctgtatggtttgcgtaaagccaaatccggtaaagtgatattttgtgatgagctaattaattcactgtccgttaagcaacggcttaaacgaggcttagtgtatttgcccgaagataggcaagcctctggattgcatttggattcaccattaagttggaatacctgcggattaacctatcatgatatgggcttttggattgatgagtccaaggagaaagcaattttagaacgctattaccatgctatcggaataaaatttaatcatgttgagcaatcggtacgtaccttatcaggtggtaatcagcaaaaaattttgatcgcaaaatgtctggaagccgatcctcggttgttgattgttgatgagccaactcgtggcgttgatattggtgcgagagcagatatttatcaattaataaaaagtattgccaaacaaaatgtagccgtgttgttcatttcatctgacttggaggaaatagaacaaatgtctagtagagttttggtaatgcacgacggtaagcttagtcaatcgttgaaaggtgaagatatcaatactgataatattatgcgactggcattcagtagttaggaggcattatgtggaaatttattcagaacaatcgtgaattaactattttagctgccattttgttgttatttggattgctaggtgtggcggatgactttagcttacaaactctcatgatgatttttaactcgacccaaatattagctttgttagctattggtgcgacctttgtgattttaactcgtaatattgatgtctctgtcggctcaattatgggattaagtgcagtagttgttggattagtgctaaattcaggttattccctactgattgcgtgcactattactttactgtgcgggattattgcaggtggggtaaacggtgtattggtctcagtacttagaataccggctattgtggcgacattggggacattaggtttatataaaggcttaatgttagtattaactggcggtaagtggattgaaggtttgccacattcattgaaaacattgtcagaagaaattttattggggttttcgcctattgggttagctgttcttttcctcattttagtcacgtactacttttttactcacacttatattggtcgttgtttttatgcagtgggggataatttacaaggtgccttgcaattaggtgtaaaggtgaatgttattcgcgttagtgcatttgcagtaaacggtctaatggctgctttagctggaattatttttgcttctcaaatcggttttgtgccaaattcaactggtaatgggctggaaatgaaagcaattgcggcttgtgtattaggtggaataagtttactgggtggtgcaggtaatattattggtgctgtattaggggcatatttcctgattcaaattgatacgattttagtactgatgaaagtgcctgcctattggaataactttgttgctggtgtggttctattagctgtattggtatttgacggtagaatccgagtaatgattgtcaataatatcaaacaacagcgttatgcccgttttcttaaagataattcattgcaggagaatcaaaaatgattaagaaatacagctgggaaatagctctcttttgtctactgatactggaaattatcgggttcggtttggttaatcctcggttattggatctcaatgtcttatttaacagcaccagcgattttatttatatcggaatgttagcattgcctctaacactgattatagtcagtggagggatggatatttcatttggatctgtagtggggctatgtgccattactctcggcgtattatttagactaggaataccgttaagtgtagcaattgcggtgacatttgcagtcggatcattgtgtggtgcgattaatgctgtactcattatctatactcaagttaacccgctggttattacgcttggcacaatgtatctgtttggtggtggtgcattgttattatcaggttttgctggtgcaacgggctatgagggtattggtggatttcccgatgtgttacttgattttgcaaatctcagttttggtattattccaacaccgattatttatttcttaataatgacatcactgttttggctgttgatgcatcgtactcgtattggtcgtagcacatttttaattgggcaaaatttacgggtctctaagtatagtgctgtaccggttaatcaaactctatttattatttatccgttaattggtttgattgcggcttttgtcggtgtgttgctggtatcctactttggttcagctcgttcggacttagggagttcgttgttaatgccggcactaaccgcagttgtacttggtggtgcgaatatttacggtggttcaggttcagtgattggtacagcaatagctgcattattgattggctacttacaacaagggttgcagatggttggaatttcgaatgaaacatccagtgccttgtccggagcattgttgattattgtacttatcgggaaatcgcttaatacacatcgggcagtagtgattcaatggtggaatcgaatccgagcagtttaaaataagcggttagtttatgatgatttttgtcaaaattgactgcgataaaacccctgcatacttgttgttttggtatgttttttaatcatacactcaattgaggagacgttctatgaaatactcacttttaaaaacaaccgctcttgccgtagcgttaggttttaccggttttaacatagcacaggctatggataaggtggcatttatcccaaaattagttggcgttggtttttttaccagtggtgggcaaggtgcggtcgaaatgggaaaaaaattaggtttggatgtaacctatgacggtccggcagaaccgagcgtatcgaaccaagttcagatgatcaataactttgtgaaccagggttataatgccattatcgtctcagcagtatcgcctgatggattgtgctctaccttaaaaagagcgatgaaaaaaggtgtaaaagtattaacttgggactccgatactcagcctgagtgccgaagctactatattaatcaaggaacacctactcaacttggctcaatgctagttgaaatggtatcaagtcaaatttctaaaccaaaagcaaaagttgcatttttctattccagtccaacagtgactgaccaaaaccagtgggttaaagaggcaaaagcaaaaattgaaaaagagcatcccaaatgggaaattgtgacgacacaatttggctataacgatgcaattaaatcgctgcaaactgccgaggggatcttaaaagcctatcctgatttagatgcgattattgctccagatgccaatgctttgccggctgccgctcaagcagttgagaaccttaaacgacaaggtacaatcgttgtcggattcagtacgccgaatgtaatgcgtccttacgtaaaacgaggcacagtaaatcagtttggtttatgggatgttgtgaagcaaggtcaactctctgttgcagtagctaatgaattgttaaaaggtaattctcttaaggttggcgataaattgaatgttgatggtattggtgaagtagaagtatcagcaaataaagtacaaggctatgagtttgaagcaaagggaaacggtattgtgttactacctgagcgtgttgtattcactaaagataatattgataactatgatttctaattatataggagacaatctatggcagatttagatgatattaaagatggtaaagattttggtattggtattcctcaaactaacaagctttttttcgtcaaaggttccggtgcattagattggggaatgcaatcacgtcttgccaatatctttaatcccaaaacaggtaagacaattatgttagcctttgatcacggctatttccaaggtccgacgacgggtcttgagcgcattgacctcaatattgcaccgctctttgattataccgatgtattgatgtgtacccgtggtattttaagaagcgttgtaccgccggatacccgaaaatctattgctttaagagcgtctggtgcaaattctattttgacagaactttctaacgaagcagttgcagttagtattgaggatgctttgagattaaatgtatccgccatggctgcacaggtttatatcggttctgaatatgaacatcaatcgattaaaaatattattcaattggtcgatcagggtaatcgctatggaatgcctgtgatggcagtaactggtgtagggaaggatatggctcgtgatcaacgctacttctcactttcgactcgtattgccgcagaaatgggggctcacattattaaaacttactatgttgataggggatttgagcgggttacagcaggttgccctgtaccgattgtaattgccggaggtaaaaaattaccggaattggatgctcttgaaatgtgctatcaagcgattgatcaaggtgcagctggtgtggatatgggcagaaacatttttcaatctgaagcaccaattgcgatgatcaaggcggtgcaagcggttgttcacggtggagaaaatgcaaaagatgcctaccaactctatttaagtgagaaaaacaactaagttaattaggttggctaagttagccaacctatttttcccacgttttctatgataaggagaagcttatgtttgctatgcttgttgaaatcaatataaaagaaggtaaagaaaaagaatttctggaggttttcgaacgtaaccatattggcactcgccaagaactgggaaatttgcgttttgacatattacgagatccggaaatacgaactcgtttttatgcatacgaagtgtatgaaaatgaaacagcactaaattttcatcggcaaactgaacattatcgccgttgtgtaagagaattagaatctttaatgactggttcaagaagtaagaaaatctttgaatggatattaccgaatccttatgtctaaattatcacttattcagcagttaaagcagcaaaagctgagtgttggtatcttatctgcaaattggcttcaacttaatgaagaggtaacaacattgttggagaatcagattaatgtactgcacttcgatattgctgatgggcaatttagttcgttatttacagttggagcaataggaattaaatattttccaacacattgttttaaagatgtgcatttaatggtaagaaatcagttggaagtagcaaaagctgttgtagcaaatggtgcaaatttagtgacattgcagttagagcaatatcatgattttgctttaacgatagaatggcttgctaaacagaaaacaacttatgccaatcaggtatatcctgtattaattggagcctgcttatgtccggaaacgccgatttctgaattggaaccttatttggatcaaattgatgtaattcaattattaactttagatccgagaaacggaacaaaatacccttccgagttgattttagatcgtgtaatacaggtagaaaagcgattgggtaatcgacgtgtggaaaaattaatcaatatagacggctcaatgacgctggaacttgcaaaatatttcaagcaaggaactcatcaaattgattggcttgtttctggttctgcgttgtttagtggagaattaaaaacaaatttaaaagtatggaagtccagtattatgtgacatcaataaaaagtgcggtgattatttcgtgatttttatgaaatagcttgctttttttgagatcatgagtataatctcaccactttcgatatgaaagtcgtttgatgtaatcatttattgaacgtactattacgatatgtaatagataaaatgtccccaatttggaggactaagtaggttcgctgcacttccctttatttaagatgttaaaggtgatggtgtcagtttttttatagctaattttattggagctctggtctaatgcagaaccaaagaatccgtatccgcttaaaagcttttgatcatcgtttaattgatcaatctacagcggagatcgtagaaacagctaaacgtactggtgcacaagtccgtgggccaattcctttgccaactcgcaaagaacgtttcacagtattgatttctccacatgtaaataaagatgcacgtgatcaatatgaaattcgcacacataaacgtttagtcgatattgtagagccaacagaaaaaactgttgatgcattaatgcgtttagatttggctgccggcgttgacgtgcagatcagcctaggttaattaagaggttattacaatgattggtttagtcggtcgtaaagttggtatgactcgtatcttcaatgaagatggggtgtcaattccagttaccgtaatcgaaattgaagccaaccgtgtgactcaagttaaaactcttgaaaacgatggctatactgcagttcaggttactactggttttaaaaaagcaagtcgtgtaaccaagcctgaagcaggtcatttcgtgaaagcaggtgttgaagctggtcgcggtttatgggaatttcgtactgaaggtgaagaattcactttaggtcaagaaatcaatgttgacatctttacagatgttaaaaaagtagatgttactgggacatcaaaaggtaaaggtttccaaggtggtgttaaacgttggaatttccgtactcaagatgcaactcatggtaactctttatcacatcgtgtgcttggttctattggtcaaaaccaaactccaggtcgtgtgtttaaaggtaaaaaaatggctggacatttaggtgctgaacgcgttactgttcaatcacttgaaattgttcgtgttgatgttgaacgtaaattattattagtgaaagggtctgtacctggtgcaactaatagtgatgttatcgttaaaccagcagttaaagcataagtctaggagatagagatggaattacaagttgtaggtgcaaacgcactcactgtttctgaaactaccttcggacgtgagtttaacgaagcgttaatccaccaagtggttgttgcttatgcagcaggtgctcgtcaggggtctcgtgcacaaaaaacgcgtgctgaagtgtccggttcaggcaaaaaaccttggcgtcaaaaaggtacaggtcgtgcgcgttccggtgatattaaatcaccaatttggcgttcaggtggcgtaacttttgcagcgaaaccacaagatcacagccaaaaagtgaataaaaaaatgtaccgcggtgcgattaaaagcattctttctgaattagttcgtcaagaccgtttggttgtggtggaaaaattcgaaattgatgcaccaaaaacaaaagtattagtacaaaaattaaaagatatggcgttaactgacgcgcttatcatcactgcaagtttagatgagaatctattcttagcggcacgtaacctttataaagttgatgttcgtgatgtgcaagctattgatccggttagcttaatcgcattcgataaagttgttgtaactgtagaagcggtaaaacaaattgaggagatgttcgcatgattcaacaagaacgtttgttaaaagtgttgagagcccctcacgtatcagaaaaagcaacaaataatactgaaaaatcaaatacgattgttttcaaagttgctttagatgcaaataaagtcgaaattgcaaatgctgttgagcaattgtttgaagtgaaagtagactcagttcgtacagtggttgttaaaggtaaaactaaacgtcgcggtgctaaaatgggtcagcgtagtgactggaaaaaggcttatgttactcttcaagaaggtcaatcgcttgacttcgttgaaggtgcggctgagtaatttcggaggagaaaaaataaatggctatcgttaaatgtaagccgacctccgctggtcgtcgtcacgttgttaaaatcgtaaaccctgaattacataagggcaagccttacgcaccgttattaggtactaaatctaaaactggcggtcgtaataatttaggacgtatcactactcgtcatattggtggtggtcataaacaacattaccgtgtaatcgatttcaaacgtaacaagttagatatcccagcggttgttgagcgtcttgaatatgatccaaatcgttctgcaaacattgctttggtgctttacaaagatggcgaacgtcgctatattttggcacctaaaggtttatcagcaggcgatcaaatccaatcaggtattaatgcaccaattaaaattggtaattcgttaccgatgcgtaatattccggttggttcaacagtacataacgttgagttaaaaccaggcaaaggcggacaaattgctcgttctgctggtgcttatgtacaaattatcgctcgtgaaggtaattatgtgactttacgtcttcgttcaggcgagatgcgtaaagtattatctgaatgtgtagctactattggcgaagttggtaattcagagcatatgcttcgcgtacttggtaaagctggtgctaaccgttggagaggtgttcgtccaacagttcgtggtacagcaatgaacccagtagatcaccctcatggtggtggtgaaggtcgtaacttcggtaagcatcctgttacaccttggggtgttcaaaccaaaggtaagaaaactcgtcacaacaaacgtaccgataaatatatcgtacgtcgtcgtggcaaataatattaattaaattaagaggatatgccatgccacgttctctcaagaagggtcctttccttgacctacacttgttgaagaaggtagagaaggcggtggaaagcggggataaaaaaccaattaaaacttggtcccgtcgttcaatgatcattccttcaatgatcggattgaccatcgcagtccataatggtcgtcagcacgttcctgtttatgtttctgatgaaatgatcggtcataaattaggtgaatttgcaccgactcgtacataccgcggtcacgctgcggataagaaagctaagaagtaaggggtaagagatggaaactattgctaaacatcgttacgctcgcacttcagcgcaaaaagctcgcttagttgcggacttagtccgtggtaagaaagttgcacaagccttagaaattcttactttcactaacaaaaaagcggcagctttggtgaaaaaggtgcttgaatctgcaattgctaacgcagagcataatgatggtgcagatattgacgatcttaaagttgcgaagatttttgttgatgaaggtccaagcatgaaacgtgttatgccacgtgctaaaggtcgtgcagatcgtattttaaaacgtacaagccacattacagtggttgtgtcagatcgataatagtagaggaataacaatgggtcaaaaagtacatccacatggtattcgcctaggtattgttaagccttggaactctacttggtttgcgaatacacaagatttcgctgataatttagacggtgatttcaaagtacgtcaattcttgaataaagaattagcgaatgcttcagtttcacgcattactattgagcgtccggcgaaaagcattcgtgtaacaattcacacagctcgtccaggtatcgtaattggtaaaaaaggcgaagatgttgaaaaattacgtaacgcagtagctgctattgcaggcgttccggctcaaatcaacattgctgaagtgaaaaaacctgaattagatgcaaaattagttgcaggtagcattgcttcacaacttgaacgtcgagtaatgttccgtcgtgctatgaaaaaagcagtacaaaacgcaatgcgtttaggtgctaaaggcatcaaagttgaagtaagtggtcgtctaggtggcgcagaaattgcacgttctgaatggtatcgcgaaggtcgtgtaccactacatacattacgtgcggacatcgattataacacctcagaagctcatactacatacggcgtaattggcgttaaagtatggatcttcaaaggtgaaattcttggtggaatggctgcaattgcacaacaaccggaacaacaaccagccacgcctaaaaaggctccacgtggtaaaggtcgtaagtaaggagatttgctaaatgttgcaaccaaaacgtacaaaatttcgtaaagtccacaaaggtcgtaaccgtggtattgctggtggtacagaagtgagcttcggtacctttggtttaaaagcagttggtcgtggtcgtttgacagcacgtcaaattgaagctgcacgccgagcgatgactcgtgcggttaaacgtcaaggtaaaatctggattcgtgtattcccagataaaccaattactgaaaaaccattagaagtccgtatgggtaaaggtaaaggtaacgttgagtactgggtagctttaatccagccgggtaaagtaatgtatgaaatggatggtgtatctgaagaagttgctcgtcatgcgtttgcattggcagctgcaaaacttccaattaagacaacattcgtaactaaaacggtgatgtaatgaaagctcaagaactacgtacaaaaactgttgaagagctgaatgctgaattggttaacttgttaggtgagcaattcaaattgcgtatgcaagcagccaccggtcagcttcaacaaacccatcagttaaaacaagtgcgtcgcagtattgcacaagtaaaaactgtattaaccgaaaaggcgggcgcataatgactgataaaattcgtacagtacagggtaaagtgattagtgacaaaatggataagtcatttgtggttgctatcgaacgtacagttaaacatcctatttatggtaagtttatccgtcgcactactaaactgcacgtacatgatgaacataacgaagcaaaattgggtgatgtagttgaagttagagggtgtcgtccactctccaaaactaaatcgcacactttagttcgtgttgttgagaaagcacaggcttaattgacaacgtatataagtaagaacctagcagaaatgctaggtttttggtttttttgatttatagaaatttttaaaattttactgctgataagcacgatatttaatataaattataattatattttaaaaatgattattgttttttagttttataagaaaatctgattctaaccttaaaattatttaaggataaaaaatgaaactatataaatttagaaaagaattatttgtattgactcttttagtctccggcagcagtatctcagcagagatcattgcggaattagatgaagttgtcgtatctgatagtagcagtgtagctgattttcaatcactcgcttttcaaggtggtcgtaaagctagtgatgtatttattgagggtaaagagtttaaaacacgttctgccaccttaggtaatgctttagccggagaattgggcgtgcattctaacccctttggaggcggagcaagtgctcctgtgattagagggcaagaaggggtgcgtattaagcttttgcaaaatgggtcggatattgtcgatatgtccaatatttcgcctgaccatgctgtagtcgctgatacacttttagcacagcaggttgaattggtgcgagggacatctaccttaatgtatggtatggcatcacctgccggtgtagtgaatattgtcgataaccgtattccgacttctcgtcctgagaaagggtatgagggagagatcgtttcacgttttgatacagcgagtaaagaaaaagtcttgaccgcaggggttaccttagcagcaggcgataatttcctgattcgtgccgaggggctgacacgcaaatcagagaattaccatgtgccagaggtatttattggtcaaaaattaaactacctaccggatagtcatcataaatcaaaagtaggaacgctaggcacaacttggataggcgataaaggctatttaggcgcctccgtaagttatcgtaaagaccgttacggtattcctgggcataatcatgcgtttgattattgttcagggcatttgtttgatacagataatttgaaagccattacagggggggatggtgaggcaccttatcttaatgcttacccacatttgatgacagatgctgatatgatttcttctctacatttccattgtggtgcggatatccaagggcataagcatagccatgaaagtatttatggacatgatcatgatattagtgaagcaggtcctgtcgtggatatgcgttctaagcgttatgatgtaagaggagagtggaaatcacctattccagggattagcaaagtaaaactctcgcttgcttatgcagactattatcacgatgaaaagcatgatggcaaggcacatattgataagaatgattcgcagggcataaaagatagaaagaaatatacggctgccattatgtcaggaaaaccagaagctttttatgctaatcgtggatttaatagccgtttagagatttatcatcaacctacagagcattttaatggtgtagtagggatgcagtatcaaacacaaaaaactaaagttcagcgtttggcacctagtttaaataataatggacaagatttaagtggtgagagaaaagagtctgaacgtaatccattggtaccgcacacgaataagcaattcagtgtatttgcattagagcaatttacttggcgtaattttattgttgaagtgggggcaagatgggagaaacaacgcattccaatcaaatatgatccgcataaattacgtcttgataaagctgcaggttctaaagttcgtctaccagatttatctccttatactgaaaatgctgtgtcatattcaggtactctaatgtgggattttcatccggcttatcgactgtctatcacgggctcgcataatgaaagaattccatcaccaatggagctgtattatcatggtaaacatcttgcaacaaattcctttcaatatggcaataaggatttaaagaaagagcggtcaaataatgtagaaatcggtctgatgcgtatttccgacaaatgggattttaaagtcagtgcttattaccaacgctttaagaattatattcacaatgagaatttgtatcgcgagggtaacttatttatgcgtcgctataaccaatctcaggcaaggttctatggttttgagggcgaaatcggttatcagataacgcctaatcataaaattacgttctttggcgattatgtcaatggtaaactctttggttttaaaaaattctatggtaatccgaagtttaaaagggtatgtgaacttgagaatgatggaaaaaataatctcgagaaatgtgttgagaacgaagaatggggggaggaatggagctatcataaaattggagagcaaactatcgaacgtcccaaccgcaatgcagcccgtgttccccctatgcgtttgggatttcgtctaaagagccagtttaacgataattggtctggctcattggaatatacgagaatgtttgtacaaaaacgcatatccattaatagcgtgatcaaagagattgatcgtgaggaagcagagaagcgaagagaaaatgcgaaagggcttgggtatgacggtcattatacagaacttgtccctgaagatgttacccaaggctatcacttactgaatctttctctcaattattcacgtaaaatagatggagtagaatatagtgcgacattaagtgcgaataatttgttgaatcaaaaaatctatattcataactcctatttgccttatgtaccgcaaatgggcagaaattttattttgaatgtcggggtaacattctagttgttcgtgaggatatcaaagagcggttgttttttgcaaaataaccgcagtatgttttctttaacgaaacctgttatctttttccaaaagttacttgataagtgcggtgctattgtgctaaactctgcgacctgtttaccatagggtagatgggttcgtcccgaaagggtgttttttattttaacggagcactaatatgatccaagaacagactatgctggatgttgctgataattcaggggctcgtagcgtaatgtgtatcaaggttctaggtggatcgcaccgtcgttacgctgctatcggtgatatcatcaaagttactgtgaaagaagcaattccacgcggtaaagttaaaaaaggtgatgtgttaaaagcagttgttgtgcgcaccaagaagggtgttcgtcgcccagatggtgcagttattcgtttcgatggtaatgcttgtgtgattttgaacaataacactgagcaaccaatcggtactcgtatttttggaccggtgactcgtgaacttcgttctgagaagtttatgaaaatcatctctttagctccagaagtactataaggagaaaatgtaatggctgcaaaaatccgtcaaaacgatgaagtaattgttcttgcaggtaaagacaagggcaaacgtggtaaggtaactaaagtgttaccaaacggtaaagtttttgttgagggtgttaatattatcactaaacacgaaaaaccagttcctgctttaggtaaagctggcgggttagtgaaaaaggaagcggcaattgatgtatcaaacgttgcaatctttaatccaacaacaaataaagctgaccgtgtaggttttagaattgaagatggtaagaaagtacgcttcttcaaatctaataatgaaattatttaaataactggagtaatgtgatggcgaaactgcatgattactacagagatacggtagtcaatgaattaaaagcaaaattcaactactcatctgtcatgcaagtcccacgaatcgaaaagattaccctgaatatgggagtgggtgaagcattgaccgacaaaaagttgctagataacgcagtagcggatttagcagcaatcagtggtcaaaaacctttagtaactaaggcacgcaaatctgttgcaggctttaaaatccgtcaagggtatccaatcggttgtaaagtaaccctacgtggtgaacgtatgtgggaattctttgaaagattgattactatcgctgttccacgtatccgtgacttccgtggtttaaacaccaagtcatttgatggtcgtggtaattacagcatgggtgttcgtgaacaaatcattttccctgaaatcgactacgataaagtagatcgtgtgcgtggtttagatattactattaccacaacagcgaaaagtgatgaagaaggtcaagcgttattagcggctttcaattttccattccgtaaataaggtaggttatcgtggcaaaacaatcaatgatcgcacgcgatgtaaaacgtgctaaattagctgataaattctacgaaaaacgtgaagaactaaagaaagtcatttctgatgtaaatacatctgatgaagaacgttgggctgcagtgttgaagttacaaacgcttccacgtgattctagtccagttcgtcagcgtaatcgttgccgtcaaactggtcgtcctcacggagttcttcgtaagtttggtttaagccgtattaaggttcgtgaagctgctatgcgtggcgaaataccaggtcttaagaaagcaagttggtaatttaccactttattttggaatcggagtaaaagcacaatgagtatgcaagatccaatcgcagatatgttgactcgtattcgtaacggtcaagctgcgaataaagttgcgattagtatgccttcatccaagctaaaagtggctattgccaatgtattagcggaagaaggttatattgctaacgttaaagtttcggaaggcgttaagcctgaattggaaattacattaaaatatttccaaggaaaaccggttgtagaaagtattcagcgcgtaagccgtcctggtcttcgtatttacaaacgtaaaaacgaattgccaaaagtgatgggcgggttgggtgttgctgttgtatctacatctaaaggtattatgactgaccgtaaagctcgtcaagcgggcttgggcggtgagataatctgttacgtagcttaagaagagaggtaggaaaatgtctcgtgttgcaaaagcacctgttagtattcctgccagcgttgaggtaaaacttgacggtcagctactaacagtaaaaggtaaaaatggtgagttatctcgcaccattcataactcagttgaagttaaacaagataataatcaattaacattctctcctcgtgtaggtattgctaatgctgatgcacaatcaggcacagcacgtgcattggtcaatgcgatggttatcggtgttaatgaaggttttactaaaaagttacagttggtgggtgttggttatagagcacaaatgaaaggcaatgtacttgtgctaagtttaggcttttcacatcctattgaccatgtgttaccagctggtgtaactgctgaatgtccatcacaaacagaaattgttctgaagagtgctgacaagcaattgattggtcaggttgcagctgatattcgcgcttatcgccgtcctgagccttacaaaggtaaaggggtacgttatgctgatgaagttgtacgtatgaaagaggccaagaagaaataattaaggtaacactatggataagaaatcagctcgtatccgtcgtgcagctcgtgcacgtcatatgatgagagagcaaggtgtaattcgtttagttattcaccgcacttcgcgtcatatttatgcacaagttattgcaccaaacggttcagaagtgcttgctactgcctctacagttgagaaagcaattagtgagcaagttaaatatactggaaataaagatgcagcggcagtggttggtaaaattgttgctgagcgtgcattagaaaaaggtatcaaaagtgttgcttttgatcgttccggttttaagtatcatggtcgtgtccagtctttagcggatgctgcccgtgaagctggtctacagttctaatagaggtaattttagatggcaagcatcgaaaaacaaactggtgaactgcaagagaagctaatcgcggtaaaccgtgtatcaaaaactgtaaaaggtggtcgtattatgagctttactgctttgacagtagtaggtgatggtaacggtcgagtaggttttggttatggtaaagcgcgcgaagttccggcagctatccaaaaagcgatggaaaaagcacgtcgcaatatgattactgtggctttaaatgaaggcacattacagcatccaattaaaggttctcacactggttctcgcgtatttatgcaaccagcaagtgaaggtacgggtatcatcgctggtggtgctatgcgtgctgtattggaggttgcgggtgttcgtaacgttctttctaaagcatatggttcaaccaacccaattaacgttgttcgtgcaactattgatgcattagcaaatatgaaatcaccagaaatggttgctgccaaacgtggcaaaaccgttgatgaaatcttggggtaattgatgatggcaaaaactattaaagtaacacaagttcgtagttctattgctcgtttaccaaaacacaaagctactttacgtgggctaggtcttcgccgtattaatcatactattgagttaattgatactccggctatacgtggtatgattaaccaagtttcatatatggtcaaagtggaggagtaagagaatgcgtttaaatactctatctccggctgaaggtgctaagcacaatgcgaaacgcctaggtcgtggtattggttctggtttaggtaaaacaagtggtcgtggtcataagggtcagaaagctcgtactggtggcggtgttcgtcgtgggtttgagggtggtcaaatgcctttgtatcgtcgattaccgaaatttggttttacttcaatgaaatcagctgtaacagcagaagtccgtttgaatgacttagccaaagtagaaggtaatattattactttagatacattaaaagcagcgaatgttttaacaaaggatatccggtttgcgaaagtaatccttgctggtgaagttaaaactgcggtaaccattcgtggtttaggtgtaactaaaggtgcaaaagtagctattgaagctgctggcggttcaattgaggaataattaacaaatggctaagcaaccaggttatcaaaatagaagtactcaaagcggtactagtgaactaaaaagcagattattatttgtgctaggtgcactgattgttttccgtattggttccttcattccggttcctggtattgatgcggccgtgctggctcaattacttgaacaacaaaaaggcactatcattgatatgttcaatatgttctctggtggtgcgttgagtcgtgcgtcaatttttgcattaggtatcatgccttatatttcagcatcgattattattcaattattgaccacggttcatcctgctttagcagagttgaagaaagagggagaagcgggaagacgtaaaattagtaagtatacacgttattctactctcgtattagcaactattcaggcaatcggtatttctactggtctacctaatatgctacctgggttagttcctaatttaggctttggtttctattttacagcggtaattagtcttgtaacaggaaccatgtttctaatgtggttaggtgaacaaattacggagcgtggaataggtaatggcatttcttcaattatttttgcaggtattgttgcagggttgccttcagcaattggtcaaactattgagcaagctcgtcaagggcaaatgcatctattagttcttttattgatcgcagtaattgtttttgcggtgacttattttgttgttttctttgaaagaggacaaagaagaattaaagtcgagtatgcaaaacgtcaacaaggtcgtcagatagtaggtggtcattcaactcatctaccattaaaagtaaatatggcaggagttattccggcaatttttgcttcaagtattattctttttcctgccacgttaacatcttggtttggacaaggttctaatttggaatggttaactgaattatcgctattattacatccaggacagcctttatatctgattgtttatgctgtggctattatattttttagtttcttttataccgcaatgcaatataatccgcgtgatacagcagataatttgaaaaagtctggcgcatttatacccggaattagaccaggtgaacaaacatcgcgttatattgataaaattatgactcgccttacattaattggcggattatatattacgtttgtatgtttagttccttatattatgacatcagcttggaatgttcagttttattttggtggaacgtctttgttgattgttgtagttgtaattatggatttcatcgtacagattcaaagtcatttaatgtcaaccaaatatgaatctgcgttgaaaaaagcaaaccttaaaggttttggacaataaatgtccatatagtaaaaaggataagtaatgaaagttcgtgcttcagtcaagaaaatgtgtcgtaactgtaaaattgttaaacgtgaaggtgttgttcgtgtattatgtagcgaccctaagcataaacagcgtcaaggttaattgatatttttcttgcaaagaaccagctgggtatatataatactcagctcatttatgtccttgatatgctgtttgagtatcctgaaacgggcttttcaagatcagtatatcaaatttaatcaataaaataataggagtgcatagtggcccgtattgcaggcattaacattcctgatcaaaaacatactgtaatcgctttaactgcaatttacggtatcggtaagactcgagctaaggcaatttgtgcagctgcgggtattgctgaagatgtaaagatcagagaattgtctgaagagcagattgataaactgcgtgacgaagttggtaaatttaccgttgaaggtgacttacgtcgtgaagtaacacttaacattaaacgcctattagatttaggttgctatcgtggtttacgtcatcgtcgtggtttaccagtacgtggtcaacgtactaaaactaatgcgcgtacccgtaagggtccacgtaagccgatcaaaaaatagtcggggtaaggttaaatggctaaaacaccagttcgtacacgtaaacgtgtaaaaaaacaagttgtagatggcgttgctcatattcacgcatctttcaataatacaatcgttacaattactgaccgtcaagggaatgctctagcatgggcaactgcaggtggttcaggtttccgtggttctcgtaaatctaccccgtttgctgcacaagttgcggcagaacgttgtgccgaagttgtaaaagaattcggtttaaagaacttggaagttatggttaaggggccgggtcctggtcgtgaatcaacaatccgtgctttaaatgcagcgggatttcgtatcacgaatattacagatgtgactccgattccacataacggttgtcgtccaccgaagaaacgtcgtgtttaatgacgtcataggatagttggagaaagaaaatggcaagatatttgggtcctaagctcaagctaagccgccgtgaaggcactgacttattccttaagtctggtgtgcgtgctattgatacaaaatgtaaaattgatacagcacctggtcagcatggtgctcgtaaaccgcgtttgtcagattatggtagtcaattacgtgaaaagcaaaaagttcgccgtatttacggtattttagaacgtcaattccgtaactattataaagaagcaaaccgcttaaaaggtaatactggggagaatttactggtattattggaaggacgattggataacgttgtttatcgcatgggctttgctgcaactcgtgctgaggctcgtcaattagtgagtcataaagcgattgttgtaaatggtcgtgtagttaatatcccatctttccaagtttcagttaatgatgttgttgctgttcgtgaaaaatctaaaaagcaagcacgtattaaagcatcattagaattagcagagcagagagaaaaaccaacttggttggaagtcgaagcagctaaaatggaaggtgtgttcaaacgtgttcctgagcgttctgatttatcagcagacattaacgaacatctgatcgtagagctttactctaaataatagttaaggctttgtagcaaagagaggataaaatgcagggttctgttacagaatttttaaagccacgtttagttgatattgagcaaattagttctactcatgctaaagtgatcttagaaccgttagagcgtggctttggtcatactctaggtaatgcattgcgtcgaattcttctatcttctatgcctggttatgcagttaccgaggtggaaatagatggcgtattgcatgaatatagtagtaaggaaggtgttcaggaggatattattgaggtacttctgaacttaaaaggtctagcggttaaagtacagaataaggataatgtttttctgacactaagcaaatctggaattggccctgttgttgcagctgacattactcatgatggtgatgttgaaatcgtaaatcctgatcatgttatctgtcacttaacagacgaaaatgcgtctattaatatgcgtattcgtgtacaacgtggtagagggtatgtgccggcatcatctagagttcattctttagatgaagaacgtccgattggtcgtttgttagttgatgcttgttatagtccagttgatcgtattgcttataatgtacaagcagcacgtgttgaacaacgaactgacttagataagttggttattgaactggaaacaaatggcacaatcgagccagaggaagcgatccgtcgtgctgcaacgattttagcagagcaactagatgcctttgttgatttgcgagatgttcgtcaaccagaagttaaggaagaaaaaccggagtttgatccgattttattgcgtcctgttgatgacttagagttgacagttcgttctgctaactgtttgaaagcagaaacaattcattatatcggtgatttggtacagcgtactgaagttgagttactgaaaacacctaatttaggtaaaaaatctcttacagagattaaagatgtgcttgtttcacgcggtctatcacttggtatgcgcctcgaaaattggccaccagcaagtattgctgaagactagtttggtcataggttaaagatttttctgagaaggataaggtcatgcgtcatcgtaagagtggacgtcaactaaatcgtaatagtagccatcgtcaggcactattccgtaatttagctagtgcattggttagtcacgaaattatcaaaactaccttgcctaaagcaaaagaattacgtcgtgtagttgaaccgttaattacattagcgaaagtagatagtgttgcaaaccgccgtttagcttttgctcgtacacgcaacatcgagacagttgcgaaattatttaatgaattaggtccacgttttgcacaacgtgcgggtggttatactcgtattttgaaatgtggtttccgtgctggtgataatgctccaatggcgtacattgagttagttgatcgtccagccttagctgaagaagctaaaacagagtaatttataactcatttaaaaagcccacagtaaaatgtgggctttttgtagtaatcatatttattttctattctattccctatcatcaattcctatcaataaaaaatttccgtttatattacataaacttctgaatccaacattggtaattttaaaaggatttttatttggacgttttgtgtagtcaaagctctcatggtgatgaccgtgaaaaatatgctttacttgcattgatgtggctaaattattaataacagaaaatcctaaaggatgaggttttggtgcctcatgacatattagtatatctgctttttgtttttctaatgcttcaatatcagaaggaaagattgaagttctatgacgcaatggaatacctcctcgccaaattttttccggaggagcgtattggcaataatggatatgatcaaaaaagagcggtttatttggtggcatccaaatttgtccacgaaacacgcctcctaatccggcaatttttattccttgaatgtcgacaactttaccgtgtaaattacgtgatttccattttgtaccccataaggcctcatatgctgaaactgttttgctatcatgatttccatggataaaccaaagatcacaaaactgtgccagtttatccagttcatcagaagtagttaattgtaaatcacctaaaataataagagatacatttgcatgttcttgaataaaagggtaaagatgggaataacttccatgtggatcaccagcaaataaaatcataatattattccttaaaaattgaaggtgtgattgtttccacggttaagtccaaaagttcttcgttgagtactttctcaacaatatttttcacttgattataacgttccaagtaactgggtgagtcaatttcaatataagctacactatgcttatctaataatttttttaagagttgttggaagcgttgacgttgtttagcatttcctaagctacgcaagccatcatctacccattgggtattattatttaataaaatggtcacatcaaagggatattctttgatcatggagtctaagaaagggtgtgcttttccttcatactgaatacaaaatgcctgagttgtaataaagtctgtatctacaattgcaactttgtgtgcatgcctgacggcataatcaatataacgctgatgacctaatgctatttgtggataatcagaatattgcatagcttgttcattaccccccagtttttcaaaaacaaactcacgtccatattcccaagctgatgtagtattaaatactgtagctagcttattgacaagagttgttttaccgctactttctccacctaaaatagcaattgtttttgcaaaaaatgggcgaacttctttaggaatgaatttccaatagtgaaatggattgttacgaatttttgttgcagaaatattaaggaatcggcgttttggatcaactaattcgacttgtaaatttaaatatttttcataaggtactttatcttggatttcactgctaaaaaccacgctaggattaacgtttttttccttaaatagatattttacctgttcagcccatgccgcccagccattgggataacttggtataccatcttcaataagatgatgaataacaatttgatttttctgatatttaaaaatttgttgcatccaacgtaagcgatcttgcacagttggcattcgtttcattttactgtcatagaatagttttaaatctcgctcagtatcactacatacaacgacatgaagttcatctactttgctaaatgcttcgtaaatcatattaatgtggccggtatgaacgggataaaatttaccaaaaataacgcctacttttttgttatcttgttcagtgatctgtaacactttatgcaatgctgaaagttttgtcgcacttggatttttaatttttccacttactaattgattaaaataagcacgagtaatattggcttgcgtacaaagatcattaactttcaaatttaattgcttacgtttttgttgcagatagctgaaactcgacattattttttccttttatatttagagaatatttaataggtaacatagaaagtgcggtaataaaccggtgagttttttatttttcttgtaattgttctaaacgtttctccaattcaaccagtttttcacgagttctcattaaaacttgtgtttgcacatcaaattcttctcgtgtcactatgtctaatttagataattgagattgtaagatttgttttagtttcatttcagcatcttgacccaactcttttacaccttgcgggagagcatcttgaatttgttgtataatttgttctatttttttaggattcagcataataagctccattttgatataaattgccccattgtatgcaatcttattcaaaataaaaacattttttcttattaaacgttaagatatactatgcacgcattctcagggcagggtgaaattccttaccggtggtaaatatttcgatataagcccacgagcgtttacttattttagtaaggtcagcagatttggtgaaaatccaaagccgacagtgatagtctggatgaaagagaatagagcgaggtattatacttatcgttgttgtttttctatttatctgatagaaaaaatccttttatcatcagccctgattctggtatctattaatttatttaaaggagtttactatgaatcagtcattattatctcagtttggtacatctgaagaacgagttaaacgtgcgattgaagctttcaaaagagggaacggagttcttgtccttgatgacgaagatcgggaaaatgagggtgatcttatttttccggctgaaacaatcacagttgaacagatggcaaaattaattcgttatgggagcggaattgtttgcttatgtatcactgatgaactttgccaacagctcgatttgccaccgatggtacaaaataacacaagtattaatcaaacagcgtttactgtgagtattgaagcggcacaaggtgtatctaccggcgtatcggcacaagatcgtgtaacgactattcaagccgccattgctgataatgctaaaccgcaagaccttagccgtccgggacatgtatttccattaagggctaaaaagggcggtgtgttagcacggcggggacatactgaagccgcagttgatctagcttcttgggcaggtcataagcctgctggggtaatttgtgaaataaccaatgatgatgggagcatggcaagaacactggagatcgtagaatttggcaaaaaatttaattacccagtggtaacaattgaggatcttgtccgttatgcctcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaataaaaataaaatgaagactatgcaagatgaaaaatctgttaaactgtgtgctatttaaaatgggttaaaggataaaattattagtaacttaaaacgtgggtttgtcttacatcgacgggattatagtgaaaccagtttgttggtcgagttattcactgaagaacacggacgtttaacagtattggcgaaaggggctcgtgcgaaacgatcggcgtggaaatctttgctacaaccctttacacctttgttacttaattggtctggtcgtggggaattaaaaatattaataaaagcagaggcgatatcattaactttaccgctacaaaccaccgcactttatagtggattttatgttaatgaattaattgctcgtctattggctccggaaaccgcatatccggatctttttcaatattatttgcaatgcttaactgcattggcaagctcaccgcaagaaatcgaaaaaagtttacgcacttttgaatttcaactgttggaggttttgggttatgccgtggatttttgtcattgtgctggttcggggaaaccagttgatgaaaagatgacttatcgctatcgagaagaaaaaggctttattgcttctttaattaaggataacctgactttttatggacgtgaattattagcttttgagcgtagagaattcgtcgataagaccgtcttgcaggcggcgaaacgttttagccgtattgctttaaaatattatttgggtaataaacctttaaaaagtcgtgaattatttacgcagaatattttacatacaaaataagttttactagatataaatttatggttttactttatcagccaaagaaacaaaaaaaattgagagcagcttttacgaccattgttcaagatttggattatcaaggattaggtgtagcaaaaattcaaggaaaaacgtggtttattgagaacgcattaccacaagagcaagtacaggttcaagttattgaagaaaaacgtcaatatggactgggtcgagttcaaaagattttacaagccagccctttgcgacaaactccaagatgtgcttattatcaaatttgtggcggctgtcaatctcagcatatccctatacatttacaacgtgaaacgaaacaaaaagcgttatttcagcgtttaaccaaactgcaaaaagaggctatagactttatgccgatgataagtggcgaagcatggcattatcgccgtagagtacgcttaagtttgtactgggacgctaaaagtaaaaaattgaagataggctttcggcaaaaaaattcacaacaaatcgtgaatattcgtcaatgcgatgtgcttgatcccttgttaaatgagttattacctaaattgcatgagttgttgagtacgtggtctaaaccgaaaacactaggacatattgaattagttgccgcagataatggcgtagcgatgttattgagagtaacagaaaaattggctgaacatgaccgcactttattgttggattttgcatttaatcatcaagtgatgttatttgtacaagatgaaaaagagatttgtcatttgcaaggagatttgccttattaccaattagatgatggttctattttacattttgatattcgtgattttattcaggttaatcgccaacttaaccaaaacatggtcaatactgcactggattggttggatttgaagaagaaggataatgtgttggatttattttgtggtatgggaaattttaccttgccgattagccgatatgtgaaaagtgcggtaggaattgagggtgttttacctatggtcgaaaaagcccgtcgtaatggggaacgaaatcattgtcataatgtccaattctaccagtgcgatttaagtcaatcttttactgagcaagaatgggcaaaggttccttttgacaaaatcttactggatccgccgagaagcggtgccgcatttgctttaaatgcattgtgttatttaatggctgaaaaaatattgtatgtgtcttgtaatccggcgacattagtgcgtgatgtggagcttttgcttaagtttggttatcaattaaaaaaagtcgcaatgattgatatgttcccacatacaagtcatctggaaagtattagcttatttgaaaggaacagataggaagtaaagttatggttgcagtgcgtggttcacatttacttaatttgcaagattttgtggttgagcaatggagtaaaagtttatctttacctgagaatgttgaacaaaaattaatacaggcttggcgttatgcacagcaaaagtgtcttattgtacaaagtgaatcggagaaaaaaattgtttgttctttgcaagctggtgtggaaatggtggaaattctgcatagtttgaatatggatgcggaaagtttgattactgcaatgctttatccattggtgaaccataaaatgacttcccttatgcaaatcaaagaagattttggcagtaatattagcaagttagtgaaaggcgtagtggaaatggataacattcgccaacttaatgccagtcattcagccaacagtttgcaggtggataatgttcgtcgtatgttattagctatggtggatgattttcgttgtgtcatcattaaacttgcggaacgtattagctatttacgggatgtagaccgcttgtattctgaagaagaaaaagtactggctgcaaaagaatgttctaatatttatgcaccgcttgcgaaccgtttgggtattggtcaattgaaatgggaattagaggattattgtttccgcactttacaccccgatacttaccatgcgattgcaaacttattaaaagaacgtcgtttggaccgtgaacaatatatcgcggattttgtgcaggagttacgtggttatctgaatgagaatttggatcaagtagaagtgtatggacgaccaaaacatatttacagtatttggcgtaaaatgcagaaaaaacacttggaatttagtgatttatatgatgtaagagcggtcagaattattgtacaaaaattgcaagactgttattccgctttgggcattgtacatactcatttcaaacatttgcctaaagagtttgatgattatgttgctaacccgaaaccgaacggttatcaatctattcatactgtcgtgttgggcaaaggtggaaagcctattgaagtgcaaattcgtactcaacaaatgcatgatgatgcagaattaggtgttgctgcacattggaaatataaagagggtgtaagtggcggacgttccggttatgaagaaaaaattgcatggttacgcaaattattagcttggcaagatgatattacagattctggcgaagtaatggcggaaatgcgtagtcaagtttttgatgatcgtgtttatgtcttcacgccaaaaggcgaagttgtggatttaccaacaggatctacccccttggattttgcgtatgctattcatagtgaaattgggcatcgttgtattggtgcgaaagttggtgggcgtattgtaccttttacttatcagcttcaaatgggtgatcaaattgagattattactcagaaaaccccgaatccaagccgtgattgggtaaatccgaacttaggttttacgcacacggcgaaagcacgtgctaaaattcagaactggtttaaaaaacaagatcgcgataaaaatattcctgccggaaaagaattgcttgaagttgaaattgcccgtttaggtatttccttaaagcaggtagagcaacacggattgcctcgctataacctgaagaatttagaagacttgtatgccggtattggtggtggagatattcgtctaaatcaacttattaactttttacaaaataaattaattaaggtgagtgcacaacaaacagatgaagaaattttgcgttatgtagccaataaaggtgctcattatgtgagtcaaaaacaaaaaacagagaaaaaaggttacgtgattgttgagggggtaggtaacttaatgtaccatattgcccgttgctgccaacctattccaggtgatgatattatgggctatatcacaatgggaagagggatttctattcaccgtggcgattgtgaacagtttatagagttgcaaaatacacaccctgaacgtgttgttgagtcagtttggggcgaaaattatgccacaggtttccgtatcagtattcgtattatcgccagtgatcgaaacggtttattgcgagatattacaacagtattagctaatgaaaaaattagtgttttgggtgtatcaagtcgtgcagatacgaaaaaacaacttgcgactattaatatggaaattgaattaaataatgtacaaattttaagtaaaattctggcaagattagcgaaattagatgacataattgaggcaaaacgtctttagataagttaggcaaagataaaggtaaagataatgaaaaaaacaaccggattggagcattttataaaatcaatagtctattccttaaaagggttgaaaagcacgattcaacatgaaagtgcttttcgtcatgagcttgtggtttgttgtattttatttcctttagcgtttcattttgcacaaagcaaaattgagtttgtgcttatgattggttctttattattggtgctggttaccgaattgttgaatagtgcaattgaagttgtggttgatcgtattggaacggaatatcatgagttatccggacgagccaaagaccaaggctcagcagcagtttttgtcgccataatccttgcactatttacttggggagtgattttattttgttagcgtgttgacatccgccctgccttcaggtggggcggatgtcaatagactagaaacgaacttccacggaagcggcaaaattgcgttttggtgcggtaaaacgattgataccttcccctttaagtcctacagaacgagcagtaaagcctctggtaaaccataagttataggcactgtcccaagttgtataattacggttgaataagttaaaaatccccatatttaatgtaacatttttactcaggttaacttgtcccgttaaatccactacaaagtaagaaggacttaagaaaggccattgtttgacatttttagcaacatcaccacttttgttaccgccaagttcatattctgtttctatagcatctttggcttttttagccgcactgtaacgaccggttaaactgatactccatttttccgtttcataatcaattcccccaaccactgtccaaggctgaatggatttaagcggatcgccatcatgattttgccctttgctataactccccttaaggcggaatgttaatccatccgacagtcccaatgccgagccgttaacagcaccgctaacttctatccctttaattaccgctttaggctcattgacaaattgagctaacgaaataaactgtttcgaaccaccccaaaaactactaggattgtagtatggatttggcttacatctttcacgctcttggataaagttatgataacgtgtgcggaaaagcccgacgctaaaatgggcatattggttttggaaacggtaggttaattcgtggttcagtgcagtttccggttgtagaaacggatttggaatataatcaatatctgtaccactaccgtcacttacaaaatataaatcttcagcacgaggcactcgaaaaccggtgcttaggcggtagccaatttgatgtgatgggtgtacttgatattccaaccccaattgccaagacagatgggatagttttcttgaggggaagttgattttggcattattgacttgccccttgagttgaggggcgtaattataacgatcataacgtccgccaatagtggctttcaatgtatcggttaaagcgacttcatcaagcaacgatagggaaaaaatacgagattttaccggaacaacttccgtataatttgggcgattttttttcattaaatacgaactagtagagaaacgttgagaattactgttttccaaaaattgatcacgaaattccactttgccggataagcgatgcgtggttcgccataatgctaatggataagttgataattctccacgagtaatagtttgatcttgaatgtactgataggaagcaagttgaaataattgattattcctaataccacgaagagctgaaagttgctcaattttctgttttgccacaaagagttttgctgtttctaaccaagataagccattatatcgatattcgagaccataacggcggtatggtgttctgtctgtggcaaatcggttctcatcgctaatccccaatgttttttcttcggtaaatttcttttctgcacgatcttctaaaaatagtgtaaagcgatgggtgttattaatatcgtagccgatttttgttaaccatgaggtggtgtggtagctgagggggttgggtttgccacgacccggaccggtaatatccgcacctttgccgttattgattgtttcatgtccccaacgtttggttaattgtgcaaaaccgaagaagcgatcagtcttgaaccccccccctatcacttgacgccattctctattttttgaggtataaccggttttggataagaagccgaaagtgcggtcaggttcgacaaaatcttcaatctctttggtggtaaaagaaaccgcacctcctaaagcaccactaccatttattacagaatttgcccctttctgtacttttaccgagctaatattttcatattccgtattattgatattgccattgtgacgttcggtagaataacgtgcggaagtggacattgttgattcggcttgcggtataccatcaacaatcaccgcaacgcgatctttgtcgacaccacgtattgcaaagccgttactaccggaacgaccgccttcaggcacgccaatccccacttcatgacgaaataaatcacgttcattagacaccatatttttccgcaattgttcggaagattgagtagaggaaaaaataggcttaacattcgccacaacggatatttcacccaattcttccgctttatttggctttgttttttcttgattcgaatcggcaagacttaatgcaggaaacatcaagctacttgaaagaaataattggttgagaataatagaatacttagatttcaaaatgaaaatctccctgtaaaaaatataatagaaatgagaatggttcttataattataaatgccctaactgtcaagttttttaatcatttttatggaaagagtaagttatttgaataaactatattgttgctaaacaaaacgttgcttgtgaaatgtatttttcactagcatttttaccaagagtttttgtattatatgagcaaaataagtatgccttgattcatatagatataaaagagttgttaaatattaatgcgataggatatgttaaaaaaattcattttacttgttatcccgatgttgctaacggcttgtgcatcttcgttaaaagtgcttgaactgccacaagtaaaaacagacagcagactttttgtgattacacaacaatttcctcaatcggaaaaaagtttgctggcgattgaagttcaacctcatcaatggcgttgggtgcaaacagatccgctcggtgcacctattgctcgtcttgttttgagtaaagcggggtggcaaaacgacggtttcgttatgccgaataagcaggcaaaacagcttttttctgcgattgcgacgtattttatgtcgactatgattttcgatgtccagcagatctcggaaaatgaatatgcacaaaaccatcggttaatatggcgattttctccgcaaaaacacggcgttaatattgagttgggggataagtctgtttggtttgtcgaacctttgagactgaattaaaattgtactaattatcagaaaataaaatgacggaaaccttatatttatcaaaacctgcgataatcagtgctatgggcgaagggctgaaaacgcatatagaaatgttattgaatgcggagcattccccgttagtgcattccgataaggtgtttagtcggcatcacattgccggtaaaatcggtgtcttcggcgagataaatttatcattacgcccatttccggaaaagcttagtgtacaacaccgtagtcgtaataatcaggtattgtggcacgcattggcagatattgaaccgcaaattgagcaagctgttcagcagtttggcaagcaacgtatcgctgtggttattggtagttcaacaacgggggtagatgaaaatatccctgttttcaaaggtggagcaagccaacaagattggtcgttagcaccttttaattttcagcaagtttcattttccgctccagcagattttgtggcggaagtttatggtttaagcggtttagtctatggtatttctactgcctgtacttcgggtgcaagagcgttaatcagtgcggctcggttattgaaaaataatttgtgtgatgcggtaatttgcggtggtgtagatacgctttcaccgctaacggtgagcgggttcaattctttatccgtgctttctgcacagcgtacaaatccgttttctcgttatcgcaacgggataaatattggtgaaggtgcggcggtctttttaatgacgaaaacaaagttaaatgatgaaagcctacaattgttcggctatgggtcgagtagtgatgcttatcatatgtcttccccgcatcctgaaggcgagggagcaatttccgcttttgagaatgctttaaaaaacgccaatgttaaggctgaacaggttggttggattaatttgcatggtactggcacggttcaaaatgatcacatggaaagccttgcggttgaaaagatcttcggagataagaccacttgtaccacaactaaggtatatactggacatacgctgggtgcggcaggtgctattgaagcggcgattttgtggggtatgatcagtcgagattataatccaacgggtaaacttcccgcacaattgtgggatcaagaaaaagatgaaaatctgcccgcacttgcgattacagatcgggatagttattggaaaatggatagacgtattggtgtaagcagttcttttgcctttggcgggaataattcggttttggtgttgggggagtagcatggttaatttgcattgtccgattacgcaagtggctcccttgctgccgcatagtaacgatatggtgttgcttgatcttattacggattttggagaagattttttgatcgccgaggcaaggattaaaagcgataatattcttattcgagaaggtaaactcagcgcattttccggtattgaaattatggctcaaggtgtggcggcttgggcgggatgtatggctgttcaagccaatgagccggtacgtttagggtatttactcggcacgcgtaaattacatatttaccaagatgagattgcgatcggtagccgtcttcagattaaaataaacatgtccattcaagatgcgacggggtttggtgtatttgattgtcagcttattgatttagccgataatcatgtgattttggaaggggcattgaatgtgtttagtcctaaggaggaacaacaataatggcaaagacagttctgattaccggctcaagtcgcggtatcggcaaagcgattgctttaaaccttgccgcacaggggtatgatattgtggtgcattgtcgttctcgtgtagatgaggcggagaaagtggcacaagaggtgagagctttagggcaaaatgcaagggtactccaatttgatgtggctgatcgtgaaaaagtgcggtcaattttagaggcggatgtagaagaaaatggtgcgtattacggcatagtacttaatgcagggctaacccgtgataatgcttttccggcattgaccgatgatgattgggatagcgtgttacgcaccaatttagatggtttctataatgtgttacacccgattatgatgccgatgatccgtcgtcgtcaagcggggcgaattgtgtgtattacgtctgtttcaggcttgattggtaaccgtggacaggtgaattacagtgcgtctaaagcgggacttatcggtgcggtcaaggcgttggctatcgaactggcaaaacgcaaaatcacggtaaattgtgtggctccggggttaattgatacggatattttggacgaaaatgtcccgatagatgagattttaaaaatgatccctgccggacgcatgggcgatcctgaagaagtcgctcatgccgtgcaatttttaatggatgaaaaagccgcttatattactcgccaagtgattgcagtgaatggcgggctttgttaaagagcggtaaggatttcaatatttttattcacaattgaacattaacagcaaaaaggatacgaagtgaaacgggtggtagtcacaggaattggcggtatcactgcttttgggaatgattggcagaagataaaaacagcttttcaacgtaaacaaaatgccgtcaaatctatgaatgattgggttgaacgttttcccgaattggatgctcgtttaggtgcggttattgaggattactatcctccgaaacattggaaccgtaagcaattacgcagtttagggcgtgtttctcagctcgtagttgatgccagtgagcgagccttggctaacgcttctttattggacgaagacggtattattttggaatatttgaaagacggtagaatgggtgtggcttgcggttcttctaccggttctactaatgatattaaagatgcggcagaacttttgatgaccggtaagtcagacggtttcaacgccaacacttatgtacgtatgatgccccatactacggcggcaaatattggtattttctttggtttaacaggtaggattatccctacttccagtgcttgctcatcaggcagtcaagcgatcggctattcctatgaagccattaaatacggattgattcctatgatgcttgctggcggtggtgaagaattttgtccgtcagaggtttatgtttttgacagcctttatgcggcaagtcgtaataatgacaatccaagccatacgccacgtccatacgataaagcacgtgacggattggtgattggcgagggcggttgtatgtttgtgttggaagagcttgagcatgcattagctcgtggagcgaatattattgctgaagtggtcggttatggtgcaaatagtgacggtagtcatgttacccgcccgcaaaaagatacgatgcagcgttgtatggaattagccctgaaagatgcagggattgaaccgagtaaaattggttatgtcagtgggcatggtaccgctaccgaacaaggcgatattgcggaaacgctggcgacagaagccgtatttgggtatgttcccatgagttctcaaaaaagttatcttggtcatacgttgggagcttgtggtgcattagaagcctggtttagcattgaaatgatgcgagatggctggtttgcaccaacgattaatcttgacaatgtagatgagcgttgtggtaaggtggattatattcaacatgatggacgagaaattcacacggattatgtcatgaacaataatttcgcattcggtggggtgaatacttctcttatttttaaacgctggacggatgaatagtggtaataagtcgctacatttcggggtgtacattatagaaattgctatggaattagctaaaattagcggcgttttgtaaagttgtggatagagaaaaagcgtatggcaaagatgataaatgatgggtgtaatatcgataatgactttgttcaaaagagtattaaacaatgacgcaacaaatctgtaatttttcatttaatcttcatgcgtggaatattgtctgtaataaagagctttccggagaggattggcaacaaggcgagcagtattggatggaaagtgttgctaaacgtgaaactgttgcacctaaactggcttttttaccgccgttaaaacgtcggcgtttaagtgaaagtgcacgtttattttttgaggcggcatggccattaaccgaacaagagaataatttgccggtggtgtatgcttcgctgaatggagaaatcaatcgtagctttgccttgtggcattctctcttaactgaaggagatgtgtctcctacttcatttagtctttcggtgcataatgcccttgttggacaatggtctgaaatgcgtcaggttaaaaatgaaacgacggctattaccgccttaaaagatagcttggaaattgccttattagaggcttttctactcttaaatgatggacaagaaaaggtgctggtcgtgctttcggaaacaccgttatcagtgaaatacaatgctcaacccgtggagcgtttgcctttgtcttatgcgttggcgatggtggtggaaaaaggctcgacttatcagcttagtttgcaatcgcaagctgttgaaagtgcggtattttttgataatgcacttgcttgggtacaacagcaatatttgggggcatcccaatggcaaacccaaagtagtcgtggaggaacttggttatggaagaaaaacttgattggctaaggcgttttctcggtacgttatttggttttatattgttcggtttcgtcggcgtgctgtttaaaattatcctttatccttatgcaaagcaatatctcaaggcagatttagctacgcaattaaaaggacgtaaaattgtcagtcgtacttgggcattttttgtgcgttatcttatttgggcgggtattttagaggttcgttaccatggttttgagcgattggggcgtaaaggacagttagttttagctaatcacccctctttgcttgatgtggtgctgatttttagtcaagtgccggagtttaactgcattgtgaaacaagatttgttaaaaaatcctgctatgagcagcccgataaaagcctgtggttttgtgccgaatacagaatcggaagaattattggaaatgagccatcggattttacaagaacaatccttattactttttccggaagggactcgtacaggttgggatggtgtggtgaaattacatcgcggtgcggtttctattgggttgcgtagtgcaaaagtgatcacgccggtggtgattaaaatgaccccgttaaattttaaaaaaggacaaccttggtataaaattcctaaaactaagattacgtatgaactaacagtgggcgaagatatcgatccgcaaaagtggttggcggaaaagcccttgcctattgcctctcgccgtttaaatcaatacttggaagattattttaactcacaaacaaaggactaaataatggaacttgaattacaacttaaacaattaattattgacagccttgcacttgaggatattggtgttgaggatattgacactgatgcaccattatttggtgatgaggggttgggactggattcggtggatgcgttagagctgggattggcagtccaaaaaacgtttggtttacaattggatagcgaacaacaaaacttgcgtaatcattttgaaagtgtggcgactttagcaagttttattcaaagtcagaaacagtagaggaaaggaagtgaaatgacagaacaggaaattcaaaaggtgttgacggaagccttagtttcattatttgaaattgatgcggacaaaattaagcctgaaacaaatttataccaagatttagaaattgacagcattgatgcgattgatttaattgactatatcaaacgccaaaccggttataaattaaaggcggaagatttccgcaatgtgcgtaccgtaagtgatgttattgctgcggttcaaaaaatcagcgaaaacgcatagtcaagttgttgaggttgataaaacagcctttggggtcaagaccttgaggggggggatagtttggtgagtatagagcagcgatgcatgcaaagtgagcctgtgcagaatcctatttggttaagtgaaatacaagaggaaaatgtccaaattttccgagcgaaagtgccgccggatctgtgctatttcaaagggcattttgctaattttcctcttgtgccgggtgtggttgagttgcaatgggtgaaagagaaaatagatgcttactttggcaaagaaatgcagatgaatcgcattgataatttgaaattccaaaaatttcttcgcccaaacgatgaatttgagctcacattaaaatgggaagaaaacaaaaatcgaataggttttcagctcaaaactgagggcgaaatgtgtgccagtggtttcgtgatttttaaaaatggttaaattattcaatttattgattaacttggggttactgcttaccggcattggttatccgctggcgtggttttttgatgaaaaacaccaagggctttcttatttagtagcaataatggcgttattatgggcaatcaaagcgataaaagcggtcagttttcatcggtttttggcaatcctaatggcgatattgcttggcgtcgtttggcttactcgtagtctggaaacaatgtattggtatcctgtcatcatcagtacggcaatgcttattttatttggtggtagcttatttagctcacaatcgcttattgagcgtttcgctcgcctacaagattccaacctttctcctcaagccgttagttacacccgaaaagttaccctagtctggagtggattttttgtgctaaatattaccatttgcaccgtacttatcctcgctggacaatatcactggtgggcatggtacacaggcggagtttcctatgtactaatggggttattgatgtgcatcgagcggttggttcgacaagaggtaatcaaaaatggataagcaacataatcaagggtatgcggattttgctttgcgttgtcagcaaatacgccaacagcttgaggaagatcaggtaaaatcggtagggttatggttagataatgcagatcaatttgcctgcgtgttattggcttgtttgaatgcaaaagtcaatgtgttgttaccgccgaatttactcaatgaaaaccttgaatggttggaacaacattcagcattactctttgataaaaaaatggttgagcaatttgggcgtttgcaaaaaactcaaaaaatccaacctcttttggataagcagaatgaaagtgaaatttggttgaaaacatcaggcagcagcgggcaggcgaagatcattaaaaaaacggcaaagcagatgtggcgggaatctcaagccttagtttctgtcttgccatttaacgccaatgaacaaatttcagtcattggtagcgtcagtttgcaacatctttacggcttgactttccgtatatttttgcctttacaaatgggttggaaattaggtggtgagcagttacattaccctgaatatttactggcagaaagtcgtcattatcgcacgctttggattagtagccctgccttattgagccatctcaacttggcaagtttggatcagcatgtgcagattgcaggtatcatttcatccggcggggcgttacccgaacaaaccgcccttgctttgcgagaggaattaccttgccccgttattgaaatttacggtagtaccgaaaccggtgcgattgcttttcgtcagcaaaccggcgggctttggcaagctatgccgaacactcggttgggattaaatgatgaagaggcgttgtgggttgaaaatgcatggattgtcggacgagagcaaacggcagatgcggtgcaatttagtgagcatgggtttgaattactgggaagaattgaccgcattatcaaattaggtgataagcgtttgtcattggtgaaaatagaacaagatttgctcaagcattgttttgtacaagattgctatattgcactacattgcctacatcagcgaccactagcttgggttgctttaaataaagaaggtattgcctattttaaacaacaaggacgtcaggcagttatttcacaatttcgccaacatttacgcctgacccaagaaaaatttgctttgcctcggtattggcgatttacggacaaattacctcgcaataaccaatctaaaatcagccgtttagattttgaaaaaatttgtaccgcacttgagtatgaggtatttgcatgacagcgtttaatcccattgcgatcattccccattataaccattctgcaacggtaggtagcgtcgctgaacagcttaatcaactagggctacctgtattgatcgttgatgatggctcaagtcttgaacataaagcagtgattgagcaatttccacaaaatgaacagctttccattttattttgtgaaatcaacggtggtaaaggtgctgcttttaaagcaggcttaaaacagacacaaaaacttggatttagccacgctattcaagtagatgcagatgggcagcataatataattgatgtcaagaaaatgctcgaacaagcggaaaaatcgccgaatgcaatagtatgtggtaaaccgatttatggcaaagatgctccaaaatctcgcttatatgggcgaaaaattaccgatttttggaatgcaatcaatacgttatcctttgatattaaagacgggatgtgtggttttcgaatttatcctattgctcaaattatgcccattcttgcacaagagcaaattggtggtggtatggattttgacacagaaattttaatccatagttattggcagaaaattccgcttatttgggttgataccccagtaaaatatgaaaaagatggcatctctcattttcgtggttgggcggataactggctgatcagcaaaatgcacgcacgccttttcttccgtatgctcaaacgactctttacaggaaaaattcgatgaataaacattgggcaaaacaacaagagcgtggtactgccttttttctaaccttaactcgtttaattgtgaagtatttgccattgcccataattcgagtagtgaatttttgggtggtgttatatttttatctcacttctcggcaaaaacggtgctacattgcagaatatcagcaaaaactgaccgctctttttcctgaaactaagttacctaaatatgcggtatttagacaatttctcgcttttggcgaagccattactgatcgtttcgccgtatggcaaaaaaaaattcgttatgaacatcttatcgttgatgatgcggataatctttatgcagatatcagcggcaatggtcgaggacaaattttggtttgctctcattttggcaatattgagatctgtcgggctttgttcggtagcggacagcacgaaaattttaaactgaatgtactggtacataatcgacatgccgtagcatttaacaaagcattgggtgatgcaggtgctgatgaattaccgctgattcaagtggaagacctcaatgtacaaaaaatgctggaacttgctgaaaaaattgatcgtggcgaatggattgcgattgccgccgaccgcattcccgtacgtggcgataaaacggagccggtcaattttttgggttctccagccgagtttcctcaaggtgcttggctgctggcaagtttattgaaagtgccgcttaataccatcttttgcatcaaagaacaggggcgttaccgtttgcagcttcgccgttttagtgaaagtattcaaggtcgaggaaaagtgcgtgaacagaatataagaaatgtcatgcaaaaatatgcggatttactggcaaaagaatgtgcaaaatcaccatttttgtggtttaatttctatgatttttggcatcgcaaagattaacttacttttctcaaggagattttatgaaactgatcaaaatattagctttaactttttctgcggttgtgattgttgcttgtgcacctcgtgatacaacccattatttatctattcaggaagccttaagttctcctgaggctaaaaaaatactgaatcctaaaatcaagctttattttggtaaacctgcaccgggtcaagtgattcaaaaaggggcggttaccaacccgaaaacgaatgcggtgaataaaacagataaagaagcgtgccaatgggtattcttatctgcagtgaaacgtttccaagatcaagcggtagctaaaggggtaactaaagtgggtaacctcgtgagttattacaagaaaaaagaatatagtagtaccactaaatatgagtgccatgccggtagaagtattgctggtgtagcattaaaaggcgattttgttaagtaaagctattaataatctaggataaacaagcggtttaatttcttgaaaaaatgagcaaaattaaaccgctcttttgcttaaaatgagacttaaaaaacacatttacgctgaacatttttccgactatgaaatcccattttttgatgtggactccatgtttattatgtggcatggtcattatgtcaaatatttagaaatggctcgctgtgcatttttagaagaaattcactatacctacgatgtgatgcgagaaaaaggttacggctggccaattgttcaacttcatttgaaatatgttaaacctgccgtatttcgccaaaaaattcgggtgcatttagctgttgtagaatacgaaagctgtatccgtattgattacaccattactgatttagccaccaaacaaaaactgacaaagggtagtaccacccaagttgccgttgatatttcaaccggtgaaatgcaattacaaacgccacaatcttggcgtgatgcgatagaaagctatcatgggtttattgctgagtgagagagcgttaatgaaaaaatatctttttgtcttgttaatattattatgttgcaaaaatctttgggctttttctcaggatgatttagtacatttgttacaaaagccacagaatacgcaaggtgaatttagtcaacaacgttatttaaaagccttaaccaaacccattatcacttcaggaaaatttattttaataaaaaataaagggttggtttgggaaacggaaaaaccgtttacacatcaattgaaagtgacggcaaaaggcattagccaatggaatggaacagcatgggaaaaccattctcgtttaggtcagggtgagcaaattaaactattcttaggcttattgtccggcgatattcaagcacttgcgacacaatttgacgtagtgctttcaggagatgaaaaaaattggcaacttcagctcatgcccagcagtttgctgatgaaacaaatttttaatcaaattattattcagggcaatgtagctgtgcaacgtattgaattgcatgaaaaacagggagatcgtaccttgattttgtttaataatcagcagattaaccttccattatcaccctttattcaatctgccttccaataggaatttgcatgcgcaaattattgaccgtttaccgcttaatttttgccggggttttatgtcttgtggtggcgatttttatgtatcatttacaaacaggtaaatggttacaaacggatctacatacacttttgccggacagtcaacactatacaaaaattcaattagaggcagataaacatcaagaacagcaatttaatcagcaagttattgcattggttggacattcacaatcagaagctgcttttaaattgacggaaaaagttgcagaacaatggcaaaaaagtgggttatttcaaacgttatctgtaaaaaatcaaccgaatttagctgaacttcaacagcagattgagttattaaaattagccacactgcctatttcaacacgaaatcagattattcaacagcccgaacgttattttcagcaatatgcagagcaaatcattaacccgttcggttatcaaaatttgctccccttggaacaagactggcttggttttgggcgttttgtattgtcgcaatctcagcagcaaagtcaaattcagtggcatgcagaaacaggtatgctctatgctgttcaacaaggtaagacatgggttttattaacaggcaaaattgttgattcagatttgatcaaacctcagcaaaatttaaccgcacttcttaagcaaaatgcacaatttattcaagaacaacaaggtcaatggttaagtacaggtgcggtgatttttgcggattattcacaacaacaagctaaatatgaaagcacgatcatgggcgggttaggtatcagcctaaccttgcttttactgttgctggttttccgtagcttacgcatattatggttatttttaccgatttctgtaggtatggttgcaggtattactgctactattagttgctttgggcagattcatattttaacgctcgtgattggcacgagtttagtgggtgttctgattgattttccattgcattggctgacatcatctctctttttgcgtcaatggaatgccaataaagcgatggcaaaacttcgccttactttttttgtcagcttattggtgactttgctgggttatgctttactgggatttactgctttacctatcctaaaacagaccgcacttttttccggtatggcgttgatttttgctgtcttaacgaccttcttgtatttgcctctatttttccgacattaccagtcaggtaagtcgttgtttttacgccgaattttgcaaataaatttccacgttaagattaattcattattaaataagattttatttgtggttagcacgggtttcattgtagtagggttgcagaaaagctattggcaagatgatattcgtcaatgggttgctatgccgatggaattgattgagcaggcacaaaaaattcgtcaaattaccggcattgatctaagcaatcaatacttattaattactgctgaaaataatgagcaattattgcaaaaagaccgaattctaaccgagaaattacaacggttcgcacaagaaaataatctgataaaatttcagtcattaagccaatggattatgtcaaaaaagcaacaagcggagtttattcaacagctaaaaaatattcctgctgaaagctatagcgtttttgatgaaattggtattccaaaggacatgattcgtcattcgctaaaaaaattggaaaaacagcctcttgttagcttagaacaggccttaaatacagaattgggaaaagtttggaaaaatctatatttaggtgagcttgatcgaggaaaagtagcaagtattattaaagtatcaggattgaataacccaaaaattcttgagcaaattgttaataatcgggatatttactggcaggataaacctgcccatctcaatcagttgtttgagcaaacccgcaaccaagcggcttggttaaaattgctctcatttggcttggcagctttattgttgtggcgaatgtttggcatatcgcaaacgttgaaaatgctcagtatcccgcttatttcagttgtgtgtacagtcgcaattttaggttggttaaatatcaccatcagtttgtttgctatgtttgggttattattggtgtcggtcattggtattgattacattgcctatatgcaaacagcgaaagagccgttatcaataaaacgttttacgattagccttgcagcacttaccacgcttatttcatttgctttattagggttaagttccactccggcggtagcaagttttggcttgagtgtcagtttgggtgtgttgattagcttaggaatgattttgcgaataaagtgaagtaatggtgaatatattttcacatcctatcttatggctgattaattgcgatagatatatcatttttatggcaaaacaggattgcataagcactaaaactcaaaaagggctgatgtcagccccttgttgttagcatcaaattaaaataataccctcgcacgaatagtgccttcaatttgcttaagtttagccaataattgagcggtatcttctgtttcaacatcgattaccacataaccaatttttgcctcggtttgtaaatattcagctgcaatattgatattttgctccacaaatatttgattgattttatttaaaatccccggacggttatggtgaatatgtaataagcgttttgcattactatgttccggtagagatacttctgggaaatttactgccgatagtgttgaaccattatcggaatatttgacaaatttatttgcgacttcaattccaatattttcttgtgcttcaacagttgagccaccaatgtgtggtgttaggataacattatcaaaagcacgcaatggcgagataaactcctcttcaatcgaggcaggttctttcgggaatacatcaattgcggcaccacgaatttttttgctttctaacgcctgagttaaagcgtcaatatcaaccactgtgccacgggcagcattgataaaaatacagttcgcctttaattgtgcaatgcgttccgcattcattaaattttttgttgaggaattttccggcaaatgtaatgaaaccacatcacaggtactcaaaagttcttctaagctattcatttgttgtgcattacctaaaggtaattttgtttctatatcatagaaatacacattcatgcctaacgcttctgcaataatacttagttgagatccaatatgaccataaccaataatacccaagcgttttccacgaacctcataagatcccaccatggatttattccataaacctcgatgcacatcggcattggcttgcgggatattacgcattaataataagatctcaccaagcaccaattcagccacagatctggtattggcaaacggtgcattgaaaacaggaataccacgtgcttttgccgcctctaaatccacttgatttgtgccgatacaaaaacaaccaattgcaattaattttgttgcttctgctaatatatcctccgttaaagacgttcgagaacggataccgataaaatgtgcatctttgatagcaatttttaattcttcaggttctaaagccttccgatgatattcgatattggtatatcctgctgcttttaacacctctaatgcattttggtgtattccctccaaaagcaaaaacttaatttttgatttatctagtgatacttttgttgtcatattgcctctccgtatatttaaataattattcaataatttttgtaccctccggcgtacctacaataacaatatctgcagaacgtaaagcaaaaatcccatttgttaccacgccggccacattattcaattctttttccatttctatcggattcataattttaaagttatatacatctaaaataacattaccattatctgtaagcacattttcacgatattcaggtgaaccgcccaacgccactaatttgcgtgcaacttgagagcgagccattggaatcacctctatcggcaaagcgaacgttgagcctaatacatccacttgtttagaactgtctactatacatatgaatttttttgccaatgcggctacaattttttcacgtgtcaatgctgctccgccacctttaatcatcattttttgcggattaatttcatctgcaccatcgacataaatatctaaaccggatacatcatttgcactgaatacctcgataccttgtcggagtaataattcttctgacgcttttgaagctgcgacagcacctttgattgtttcttttattgtacctaatacttcaataaaacaattgacagttgaaccgcttcctacgccaataatgctatcaggtttaacatattgcagtgcagcttgagcagccatttttttcatgcttaactgatccattttttatcctttttctatgattttatgtttatgtcgtacaaagcaaatgtttttataagttcactactttaaaactattcacttaaatacacaagctaatcaggcaaaaactccgttaataattcattaaggaaaagttttccttgttcagtgatttgccaagtgcggttcgtttctgataaatagttcttctctaacgcccaatcaatttgtttttgtaccgcactttgtgctaatccggttaacagttcaaattgttgtttttccataggttccaataaacgaaagcgattcataaaaaactcaaatggacgttctgaaaaagggatatttttttcctcatatagatattcaccacgcatatagcctttagggtgtttcgttttagaaaaacgtaaaatttgtccatcagcaaaactcaatttaccatgtgctccacacccaatagctaaataatcaccaaatctccaataattcaaattgtgttgacattgaaaatcaacttttgcataagcagaggtttcatattgttggtaacctgctttggataacaattgatgaccctgctcaaaaatatcccaaagttcatcttcatcgggtaatttcggcggacgatatgcaaacattgtattaggctcaattgtgagttgataccaagataaatgaggcggttttaaagcaatagcttgctgtaaatcgtccagtgcttgcaccaaagattgattgggtaatccgtgcattaaatccaagttaaaactgtttaatccggaatgttgagcaaaacgcaccgcactttttgcttcaactgcattatgggcacgccccagtctctgtaatttttcattattaaaactttgaatccctatagaaattcgattcactccggcttgtgcatatccgacaaaccgatcgctttcagctgttacaggatttgactcaagcgtaatttcaatattatcctcaaaaggaataagttgtttaatttgattcaataaataatcaatactttgtacagaaaataggctaggagttccgcctccaatgaaaatagaatgcaattttcggtcggctattgaggcatgataacgtaccaaatcttgctttaagtcagtaagcaaatgggtaacatattcagtttccggaataagccctttttgtacatgggagttgaaatcacaataagggcatttttgtacacaccaagggatatgtatatataaacttaatggaggtagctgaatgggaaatagtttaacaagggagaattgtgtcattatttcaaccgctcttttaatactgcgagagctttggctcgatgtgaaattttctttttctccgatgtttccagttcagcaaaagtacaacctgtttcaggatagaaaaataagctgtcataagcaaagccatttgaaccgctttcagaaaaagcaattattccatgacattcaccttcagcaataattggcgatggatcagtgtcatgttgcagcatgacaatacaactcacaaatttggcatgacgctcattaacgggcacattagccagttccgctaataacttttctctatttttctgctccgcatctttgccctcaactccggcatagcgagcggaatataatcctggtgcaccgtttagtacaggaacaaccaatccactgtcatcagcaatcgcaggtaagcctgacatttttgctgcataacgtgcttttagaagtgcattttctacaaaagtcaaacctgtttcttccggactgtcaatacctaaatctttttgtgcaataacatcaaaaccaaattcagataatacatttgccatttcttttactttcccaggattagctgttgctagtacaattttttgtttcattaccgttcctttttcaatgaataaccagtttgctattttaagcacttcgcaggtattttttaagatgctgttttaagataagtcccctgaatgataaaatatttttgctttctacagaaatatcccctcaacattgttaaaaattgaggggatattgatttatattgtcaaaagttatttggcatgtgtctagaaaatgatacgatctctattcttttctagtgttgctttgccaatccccttgacttcaagtaactgttcagccgcggtaaatttaccaaatttttcacgatattgaacaattgcctcggcttttttgcttccaattcctattaaagcgtgtttaatttcttccgctgttgcagtattgatgttcaatttatcgctaataatgacctgttcaacttgttgtgttgcttgggctgaactaggtggttgagttggtgtttctgcaaatgcattaaaagcacccaaagcaacacttaacatcaataatgatttgaaaaatgaggttatttttttcattttgtcttccttacagtaaatgataaccaaagtttaaaaaattgaactgttgaattgattcaacaacagacattttgcatggaggcgaaaaacttacgagaaaatcactgcacttttacgatcaagatcgcaaaaataacaaaatggattagcaaaaagagacttttttgtgaaaaaacgagtattcactaaaagcgaatccccgtttttttgaagagaaattattgacgtactgcgatagcttcaatttcaataccgacatcttttggtaagcgagctacttcaacacaagaacgtgctgggaaagttgggtgatgattttctataaagaaacgctcatactcggtatttactgtggtaaattgatttaagtctttcacaaaaacggtggttttaacaatatctgccacagtcaatcctgcttgtgcaagaattgctttaatattttccaaagattggcgagcttgtgccgtaatatctgccggaatttcccctgttgcaggattaaccggaatttgaccggaagttaaaactaaattacctaaatccacagcttggacataggggccaattgctgccggtgctttttctgtgtgaataacttttgtcattttttctccttaattcaacgatattttcacgctaactattgtacgcttttaaaaataaacttaaagcccattcatggcgtttatcaagcgaatttcttcatattgtgccagatcctcgaaaaaaatttctcttgcaataattttcttttgctcaagtaattttgctcgttgtgtaccttctaataacggtttatcgggagttatccattgattattttggcgaaaaatcaagtttccaatagagcaatccgttactttgccttgacgaataatcataatttcatcacattcttctttttgttttaagaggttgtttaacaatgttcgatctgaaaatttcaaactgtaatcaatatgatcacagaaaacaggtttaaaagttcgataaactttttgttgataaggaaagcattgaagaacgtaatcatgatggttgtaatcaatacggcaacgtattaagccttctcggtgggtgaaaagtgcggtatgtttagcaataatttttgctaaatcaaatggttgtaatttcattttgggataaaacttcagcaggcttttttcataacgttgctgatgataggaaatatttttagcttgaccttgttcaattaagatcgtttcaaataaaggaaattgccacattttctgttaataattatcaaatagtcatatctgcatcaaaaattatttctctacttaaatcttgagataaagaaataaaagctagctacttagttttcctcactattggataaaccgctgtttaggctctaaatagtccttaattcgcttattttatgaggggtaaatatactttagcacacagctcgttgtattcatcttctatatcactttgaattgtaatgccacctccgctacgaaaataatagccatcgcaccgtttctcaataaagcgaatagcgaccgcactttgtaaggtttctccatcaaaaataccaaaaacaccggtgtagtaacctctcttttgctgctccgcttgttgaataatttccaccgttttttcttttggtgcaccgctaatagaacccgccggtaatagtgcggctaaaatatgtccaatattatgtcgccaattttcctctaactcaccacaaatttcggaacttgtttgcaaaattgcacctcgttcagtatgaattttttcaacatagcgaaaacgtttaactttaatatttttagctacaatagctaaatcattacgcattaaatccacaatggtatagtgttcacacaactctttttgtgaatttagtaattgttgctcagcattttctaacgttgcatttatcgtgcccttcattggataggtgtaaattttattttcataaatttgaataaacggctcaggcgaaaaacaaataaattcatttttaaacaataacttataacttgcttttgtttgttgaaataactgcatcaaactataatttgtttcaattttgctcggataagtaagatttaacaaataagagttacctttttgtaactcgctcttaaccagctcaaatccctgctgataatctttaaatttcataggattaaatgaaaaatgacaatcttttgcggaaaattcaaaatgccaatctacattactttttattccttgcggttgtaaaatagtaaaaaagatattttcttttgctgcttgttcaatgggtaaaataattggtttttgctgttcaaaatcaatcaaaaagaaaaaaggtaatttattttgcccaaaataattagcctgccggacaaaatcaagaaattgacttgagttattcaatgacataacgatgaaaaatttagtaatatacgcaattcgctgattttagcttaagatgaaacatgaacacaaatttattagtcattaataatcatgactcttttacttataacttagtagatctcattcgccgtttaggcacgccttttaaagttgtgaatgtagaggatttatctttggtggaaatagaaaatttttctcacctgttaatttctccgggacctgatgttcctcatgcatatccccaactttttgatttactggaaaaatatcatcaatctaaatctattttgggtgtttgcttaggacatcaaactttatgtgaatttttcggcggaaaattgtataatttgcagaatgtacgtcatggacaagctaaacagctaaaagtgcggtctaattcgagactatttagaaatttacccttaacatttcaaattggactttatcattcttgggctgtaagtcctgaaaactttccggaagatcttgaaattactgcgatttgtgatgatgaagtaatcatggcgatgcaacataaaaccttgcccatttacggcgtacaatttcatcccgagtcttatatttcggagtttggtaagcaaatcatacaaaattggctaagtaattgataattataataaattcataataactattaaaaataaaaaaatgatagaaatttcctatgaattttatcaataatatccattttgttagtaaggaattattatttatcatataatcagtaaagacatcaataaacataaataggagaaagcttatgacaacaactatcggtttagatcgcaatagttcaaaacaattagcaacagaattaaataatttattagcaagttatcaaatattctacatgaatgtacgtggctatcattggaatattaaaggtgtaaatttctttgaattacacgcaaaatttgaagagatttatgatgatttagtggtgaaagtagatgaaattgcagaacgtattttaactttaggttataccccaagcaatgcgtttagtgaatatttgacacaatcgcaaattcaggagcatattaatgtaactaacgcacaggactgtttaaacggtaccctacaagggtttaaaacattgttaaaacaacaacgtagtatccttgctattgcatcagatgccaatgatgaaggtaccgcttcgcaaatgagtgattatattaaagagcatgagaaattaatttggatgttcagtgcggcttgtgaaagttgtcatgcttaatttgtgtaatatcacatcattttaaatctaaaagttaaaataaaacctctagctgtgcctagaggttttttcgtttatatgaaaagctaaatattgtgtttatttgccgatacagaaagagctaaaaatattgcctaataaatcatcggaagtaaattgtcctgtaatttcacttagatgatgttgcactatacgcagttcttcagcgactaattcacctgcataaaattctgtcaactgaatcaatccggcttgtaaatgaatgtcggcttgttctaaggcctctaaatgacgacgacgggctaaaaatcccccctcagtgcagacttgatagcccatggactgttttaaatgctgacgcaacaaatcaacacctttttgtgtttttgccgacaatgaaataacagttaaaccgttttgttcatctaaaacttctgcttcaccacttaaatcagctttgtttcttactatggttaaaggaatatgtggcggtaattttgccataaattcagaccgcactaaatccaattcaacttgattttccgtgctatccaagattaacaaaatacgatcagcctgttcaatttcatcccaagcacgacgaataccaattttttcgacctcatcggttgcatcacgtaaccctgccgtatcaataatatgtaaaggcattccgtcaatatgaatatgctcacgcaaaacatctcgagttgttccagcaatatccgtaacaattgccgcctcacgccctgctagtgtgtttaataaactggattttccggcatttgggcgaccggcaatgactactttcattccttcacgtaaaatagccccttgttttgcctcattttttactttagctaacttggctattatttcacgtaaatgcgtttcaattttaccgtctgcaagaaagtcaatttcttcgtcagggaaatcaattgctgcttcaacataagtgcgtaaataaataactgagtcaactaattcattgattttatttgaaaactcaccttgcaatgattttaacgcagaacgtgctgcttgctccgaactcgcctcaattaaatcagcaattgcttctgcttgagctaaatctaatttatcattaagaaacgcctgttcagaaaattcgcccggtcgtgccaaacgaataccgtcaatttgcaaaatacgttttaataaaagatccatgacgatttgtccgccatgtccttgtaactcaagaacattttctccggtaaaagaattgggtgctttaaaataaagtgctatcccttgatctaatacactaccatcagaatctttaaatggaagataatttgccatcctaggtgttaaggttttaccgagtacttgttcagcaacctgctgagctaaaggtcctgatacacgtaaaatcccaactccaccacgtccaataggcgttgcttgagctacaatagtatctctactcataatttgtttccaaaagtgcggtcaaaaatcgtatagaattataacaaaaaaggcatcatctaagatgcctttcttttatttaggattatttttttactctagtatgtaagccttttttctccaaaccacgataaattaaccattgttgtgcaatagtaataaggttagaggctaaccaatataacactaagcctgcggggaagaataagaagaacaccatgaaaattaatggcataaacgtcatgaccttttgttgcatcggatcggcaacaggtgttggtgacattttttgcaataggaacattgaggcacccattaggatcggtaagataaaatacggatcctgtgcggataaatcttgtacccaaccaaagaatggggcatgacgtaattcaacggcttccataaatgtccaatacaaagcaatgaaaattggcatttgtagaagaattggtaagcaaccgccaagaggattgactttctcttctttgtaaagtttcatcatttcttggctcatacgttggcgatcttcaccaaaacgctcacgcatttcttgcaatttaggttgtaacatacgcatttttgccatcgacgtatattgtgctttggttaacgggtatagaattgcttttactactaaagtgacaccaataattgccagaccccagttttgtacaagagattggatcagggttagcaatttaaatagaggtttcgcaataaaccaagcccaaccataatcaacggttaaatccaaatgattagccacatcagccatttgatcttgtaatttcggaccagtccataattgagtatgaatagtttcagttgcaccgttttctattacaatcggagcagatcgataaccaatagaacccaagtgtttcttagtatttgtcagcgtgtacaaggtattattagcatcttgattaggaatccaagcggagacgaaataatgttgcaacaaggcaacccaaccggctttggtatgaatatctaaatctgctttttccatgtcttcaaaactatattttttatagttggtttctgacgatgaataagcaccgccggtataagtcggcattgccatgctacctgaactttcaactagtgtatgagttaattgtgcataaggaactacttcaatcggttttgggctttggttggtaatttcaaaattgacctctaatgcgtaagatccgggttttaatacaaagattttacgatagatcacaccatctttctcaaagaccaaaggcacttttaattcctgctgaccttctgctaacttaaatacatcaccttcaacttggtaatttgcacgaccagcacgactatcaatgccattttttccgactaagccgctttgtgcaatatatactttatccgcattgttctgtaataatacgaaaggtgttgaagaatgtaattctgcatcatagttcaataattcagaaccgatcacgtccccccccaaagtatttacctttaaacggagaacatcattttctaatgtaataacacgacctttagcctgtgtatcattagcaatatctgacgttgctgtaagtgcggttgagttcacttcagaaacctgagcttgttcagtcacttccggcttaggcgtgttatagtctacttgccattgctgataaataaggaaggaaatgaaaagaagtgccataaataataggctgcgtttagaatccattattcgttctctttgttgttattaatctttgggggaacaggatcgtatccgcccacattaaaaggatgacattttaatatacgtttaactgtaagccaactaccttttactacaccatgcgtttttactgcttgaataccataacaagaacaagttggcacaaaacgacagcgaggaccaatcagcgggctaatcatcaattgataaatcctaattgcaccaattaagacttttgcaccaaacgaatgtgacgtttccatagcttatccaaagtttgaaataattgctggttatctaaattaccaatacctttctttgttattattacaaaatcataattagccagctgtccttgtaataaacggaaactttcacgagaaatgcgtttaacacgattgcgatcatgtgcacgttttaaatgcttcttcgcaacagtcaaacctaaccgagaatgttccaaattattttttcgagcaagaatggtaatttcaggggtgctaacacgcaatggtttttgaaaaacgcatttgaaatgagagggagtcagcaatcgtaactccctggaaaagcctagcttaaccacagcaaagggctggattatgcagataaactcttacgacctttagcacgacgacgagctaaaacttgacggccgtttttagtcgccatacgagcacgaaaaccgtgtgtacggttacgttttaatacagaaggttggaatgtacgtttcattataatctacctaaatctaaataaaaaatttgttataccattgcccttgtaaaat

(The sequence listing continues in the following parts.)

What is claimed is:

1. A genetically engineered, non-naturally-occurring, attenuated *Histophilus somni* (*H. somni*) strain, wherein the attenuated strain has deletion of the genes HSM_0270, HSM_0338, HSM_0377, HSM_0598, HSM_708, HSM_0749, HSM_0953, HSM_1160, HSM_1191, HSM_1257, HSM_1426, HSM_1616, HSM_1624, HSM_1714, HSM_1726, HSM_1728, HSM_1730, HSM_1734, HSM_1736, HSM_1737, HSM_1741, HSM_1793, and HSM_1889 to eliminate the ability of the genes to express their cognate wild type gene products, relative to a reference virulent *H. somni* strain, and wherein the attenuated strain possesses in its genome the genes HSM_0052, HSM_0077, HSM_0164, HSM_0268, HSM_0274, HSM_0346, HSM_0394, HSM_0695, HSM_0844, HSM_0975, HSM_0977, HSM_0978, HSM_1089, HSM_1090, HSM_1212, HSM_1448, HSM_1484, HSM_1542, HSM_1571, HSM_1647, HSM_1651, HSM_1667, HSM_1669 and HSM_1794 relative to the reference virulent *H. somni* strain.

2. A vaccine composition comprising a pharmaceutically acceptable vehicle, diluent or excipient and an amount of the genetically engineered attenuated *H. somni* strain of claim 1 effective to elicit a protective immune response against a virulent strain of *H. somni* in a bovine animal.

3. The vaccine of claim 2, wherein the vaccine is in the form of a formulation for intranasal or parenteral administration.

4. The vaccine of claim 2, wherein the reference virulent strain comprises a genomic DNA sequence, which encodes and expresses 100% of the same genes as does a strain of *H. somni* having the sequence set forth in SEQ ID NO: 2.

5. The vaccine of claim 2, wherein the attenuated *H. somni* strain encodes and expresses at least 99% of the same genes as does an attenuated *H. somni* strain having in its genome the sequence of SEQ ID NO: 1.

6. The vaccine of claim 2, wherein the attenuated *H. somni* strain encodes and expresses 100% of the same genes as does an attenuated *H. somni* strain having in its genome the sequence of SEQ ID NO: 1.

7. The vaccine of claim 2, wherein the attenuated *H. somni* strain encodes and expresses at least 99% of the same genes as does the attenuated *H. somni* strain deposited under the designation PTA-121029.

8. The vaccine of claim 7, wherein the attenuated *H. somni* strain encodes and expresses 100% of the same genes as does the attenuated *H. somni* strain deposited under the designation PTA-121029.

9. The vaccine of claim 8, wherein the composition is non-adjuvanted.

10. The vaccine of claim 8, wherein the composition further comprises at least one additional antigen capable of eliciting a pathogen-specific immune response in a bovine animal.

11. The vaccine of claim 10, wherein the at least one additional antigen is capable of eliciting the immune response in the bovine animal against bovine respiratory disease complex (BRDC), bovine respiratory syncytial virus (BRSV), bovine viral diarrhea (BVD), bovine parainfluenza 3 (PI3), infectious bovine rhinotracheitis (IBR), bovine herpesvirus-1 (BHV-1), or bluetongue disease virus (BTV).

12. A method of eliciting a protective immune response in a bovine animal in need thereof against a subsequent virulent *H. somni* infection comprising the step of administering to the bovine animal an effective amount of the vaccine of claim 8.

13. The method of claim 12, wherein the administering is by intranasal, subcutaneous, or intramuscular route.

* * * * *